(12) United States Patent
Wilson et al.

(10) Patent No.: US 7,906,111 B2
(45) Date of Patent: Mar. 15, 2011

(54) ADENO-ASSOCIATED VIRUS (AAV) CLADES, SEQUENCES, VECTORS CONTAINING SAME, AND USES THEREFOR

(75) Inventors: James M. Wilson, Gladwyne, PA (US); Guangping Gao, Westborough, MA (US); Mauricio R. Alvira, Philadelphia, PA (US); Luc H. Vandenberghe, Philadelphia, PA (US)

(73) Assignee: The Trustees of the University of Pennsylvania, Philadelphia, PA (US)

( * ) Notice: Subject to any disclaimer, the term of this patent is extended or adjusted under 35 U.S.C. 154(b) by 473 days.

(21) Appl. No.: 10/573,600

(22) PCT Filed: Sep. 30, 2004

(86) PCT No.: PCT/US2004/028817
§ 371 (c)(1),
(2), (4) Date: Mar. 24, 2006

(87) PCT Pub. No.: WO2005/033321
PCT Pub. Date: Apr. 14, 2005

(65) Prior Publication Data
US 2007/0036760 A1 Feb. 15, 2007

Related U.S. Application Data

(60) Provisional application No. 60/508,226, filed on Sep. 30, 2003, provisional application No. 60/566,546, filed on Apr. 29, 2004.

(51) Int. Cl.
| C12N 15/86 | (2006.01) |
| C12N 5/10 | (2006.01) |
| C12N 15/37 | (2006.01) |
| C12N 15/11 | (2006.01) |
| C12N 7/01 | (2006.01) |

(52) U.S. Cl. .... 424/93.2; 435/456; 435/325; 424/199.1; 424/233.1

(58) Field of Classification Search ................ None
See application file for complete search history.

(56) References Cited

U.S. PATENT DOCUMENTS

| 5,866,552 | A | 2/1999 | Wilson et al. |
| 6,498,244 | B1 * | 12/2002 | Patel et al. ............... 536/23.72 |
| 6,759,237 | B1 | 7/2004 | Wilson et al. |
| 7,056,502 | B2 | 6/2006 | Hildinger et al. |
| 7,198,951 | B2 * | 4/2007 | Gao et al. ............... 435/456 |
| 7,588,772 | B2 | 9/2009 | Kay et al. |
| 2003/0138772 | A1 | 7/2003 | Gao et al. |
| 2003/0228282 | A1 | 12/2003 | Gao et al. |
| 2004/0057931 | A1 | 3/2004 | Wilson et al. |
| 2004/0057932 | A1 | 3/2004 | Wilson et al. |
| 2004/0057933 | A1 | 3/2004 | Wilson et al. |
| 2005/0014262 | A1 * | 1/2005 | Gao et al. ............... 435/456 |
| 2007/0243526 | A1 | 10/2007 | Kay et al. |

FOREIGN PATENT DOCUMENTS

| EP | 1310571 | 2/2006 |
| WO | WO 98/09657 A2 | 3/1998 |
| WO | WO 00/28061 A3 | 5/2000 |
| WO | WO 01/83692 A3 | 11/2001 |
| WO | WO 03/042397 A2 | 5/2003 |
| WO | WO 03/052051 A2 | 6/2003 |
| WO | WO 03/052052 A2 | 6/2003 |
| WO | WO03052052 A2 * | 6/2003 |

OTHER PUBLICATIONS

Guo et al, Protein tolerance to random amino acid change, PNAS, 2004, vol. 101 (25), pp. 9205-9210.*
Lesk et al, Prediction of Protein Function from Protein Sequence and Structure, p. 27 and 28, downloaded Sep. 16, 2007.*
Richard, Protein stability: still an unsolved problem (1997) Cell Mol. Life Sci. 53:790-80.*
Gao et al, Adeno-Associated Viruses Undergo Substantial Evolution in Primates During Natural Infections, PNAS, vol. 100, No. 10, pp. 6081-6086, (May 13, 2003).
Gao et al, Novel Adeno-Associated Viruses From Rhesus Monkeys as Vectors for Human Gene Therapy, PNAS, vol. 99, No. 18, pp. 11854-11859, (Sep. 3, 2002).
Grimm et al, From Virus Evolution to Vector Revolution: Use of Naturally Occurring Serotypes of Adeno-Associated Virus (AAV) as Novel Vectors for Human Gene Therapy, Current Gene Therapy, vol. 3, No. 4, pp. 281-304, (Aug. 2003).
Rutledge et al, Infectious Clones and Vectors Derived from Adeno-Associated Virus (AAV) Serotypes Other Than AAV Type 2, Journal of Virology, vol. 72, pp. 309-319, (Jan. 1998).
Rabinowitz et al, Cross-Packaging of a Single Adeno-Associated Virus (AAV) Type 2 Vector Genome into Multiple AAV Serotypes Enables Transduction with Broad Specificity, vol. 76, No. 2, pp. 791-801, (Jan. 2002).
Gao et al, Clades of Adeno-Associated Viruses Are Widely Disseminated in Human Tissues, Journal of Virology, vol. 78, No. 12, pp. 6381-6388, (Jun. 2004).
Gao et al, Erythropoietin Gene Therapy Leads to Autoimmune Anemia in Macaques, Blood, vol. 103, No. 9, (May 1, 2004).

* cited by examiner

*Primary Examiner* — Maria B Marvich
(74) *Attorney, Agent, or Firm* — Howson & Howson LLP

(57) ABSTRACT

Sequences of novel adeno-associated virus capsids and vectors and host cells containing these sequences are provided. Also described are methods of using such host cells and vectors in production of rAAV particles. AAV-mediated delivery of therapeutic and immunogenic genes using the vectors of the invention is also provided.

7 Claims, 125 Drawing Sheets

```
                 ....|....|....|....|....|....|....|....|....|....|....|....|....|....|
                          10         20         30         40         50         60         70
AAV5      1     MSFVDHPPDWLEE-VGEGLREFLGLEAGPPKPKPNQQHQDQARGLVLPGYNYLGPGNGLDRGEPVNRADE
AAV3-3    1     MAADGYLPDWLEDNLSEGIREWWALKPGVPQPKANQQHQDNRRGLVLPGYKYLGPGNGLDKGEPVNAADA
AAV4-4    1     -MTDGYLPDWLEDNLSEGIREWWALQPGAPKPKANQQHQDNARGLVLPGYKYLGPNGLDKGEPVNAADA
AAV1-A    1     MAADGYLPDWLEDNLSEGIRQWWKLKPGAPKPKANQQKRGPPPKPAERHKDDSRGLVLPGYKYLGPFNGLDKGEPVNAADA
hu.46-A   1     MAADGYLPDWLEDNLSEGIRQWWKLKPGPPPKPAERHKDDSRGLVLPGYKYLGPFNGLDKGEPVNAADA
hu.48-A   1     MAADGYLPDWLEDNLSEGIRQWWKLKPGAPKPKANQQKRGPPPKPAERHKDDSRGLVLPGYKYLGPFNGLDKGEPVNAADA
hu.44-A   1     MAADGYLPDWLEDNLSEGIRQWWKLRPGPPPKPAERHKDDSRGLVLPGYKYLGPFNGLDKGEPVNAADA
hu.43-A   1     MAADGYLPDWLEDNLSEGIREWWDLKPGAPKPKANQQKRGPPPKPAERHKDDSRGLVLPGYKYLGPFNGLDKGEPVNAADA
AAV6-A    1     MAADGYLPDWLEDNLSEGIREWWDLKPGAPKPKANQQKRGPPPEPAERHKDDSRGLVLPGYKYLGPFNGLDKGEPVNEADA
hu.34-A   1     MAADGYLPDWLEDTLSEGIRQWWKLKPGPPPEPAERHKDDSRGLVLPGYKYLGPFNGLDKGEPVNEADA
hu.47-B   1     MAADGYLPDWLEDTLSEGIRQWWKLKPGPPPKPAERHKDDSRGLVLPGYKYLGPFNGLDKGEPVNEADA
hu.29-B   1     MAADGYLPDWLEDTLSEGIRQWWKLKPGPPPPKPAERHKDDSRGLVLPGYKYLGPFNGLDKGEPVNEADA
hu.63-B   1     MAADGYLPDWLEDTLSEGIRQWWKLKPGPPPPKPAERHKDDSRGLVLPGYKYLGPFNGLDKGEPVNEADA
hu.56-B   1     MAADGYLPDWLEDTLSEGIRQWWKLKPGPPPPKPAERHKDDSRGLVLPGYKYLGPFNGLDKGEPVNEADA
hu.45-B   1     MAADGYLPDWLEDTLSEGIRQWWKLKPGPPPPKPAERHRDDSRGLVLPGYKYLGPFNGLDKGEPVNEADA
hu.57-B   1     MAADGYLPDWLEDTLSEGIRQRWKLKPGPPPPKPAERHKDDSRGLVLPGYKYLGPFNGLDKGEPVNEADA
hu.35-B   1     MAADGYLPDWLEDTLSEGIRQWWKLKPGPPP-KPAERHKDDSRGLVLPGYKYLGPFNGLDKGEPVNEADA
hu.58-B   1     MAADGYLPDWLEDTLSEGIRQWWKLKPGPPPPEPAERHKDDSRGLVLPGYKYLGPFNGLDKGEPVNEADA
hu.28-B   1     MAADGYLPDWLEDTLSEGIRQWWKLKPGPPPPKPAERHKDDSRGLVLPGYKYLGPFNGLDKGEPVNEADA
hu.51-B   1     MAADGYLPDWLEDTLSEGIRQWWKLKPGPPPPKPAERHKDDSRGLVLPGYKYLGPFNGLDKGEPVNEADA
hu.19-B   1     MAADGYLPDWLEDTLSEGIRQWWKLKPGPPPPKPAERHKDDSRGLVLPGYKYLGPFNGLDKGEPVNEADA
hu.49-B   1     MAADGYLPDWLEDTLSEGIRQWWKLKPGPPPPKPAERHKDDSRGLVLPGYKYLGPFNGLDKGEPVNEADA
hu.52-B   1     MAADGYLPDWLEDTLSEGIRQWWKLKPGPPPPKPAERHKDDSRGLVLPGYKYLGPFNGLDKGEPVNEADA
hu.13-B   1     MAADGYLPDWLEDTLSEGIRQWWKLKPGPPPPKPAERHKDDSRGLVLPGYKYLGPFNGLDKGEPVNEADA
AAV2-B    1     MAADGYLPDWLEDTLSEGIRQWWKLKPGPPPPKPAERHKDDSRGLVLPGYKYLGPFNGLDKGEPVNEADA
hu.20-B   1     MAADGYLPDWLEDTLSEGIRQWWKLKPGPPPPKPAERHKDDSRGLVLPGYKYLGPFNGLDKGEPVNEADA
hu.24-B   1     MAADGYLPDWLEDTLSEGIRQWWKLKPGPPPPKPAERHKDDSGGLVLPGYRYLGPYLGPFNGLDKGEPVNEADA
hu.64-B   1     MAADGYLPDWLEDTLSEGIRQWWKLKPGPPPPKPAERHKDDSRGLVLPGYKYLGPFNGLDKGEPVNEADA
```

```
hu.48-A    71  AALEHDKAYDQQLKAGDNPYLRYNHADAEFQERLQEDTSFGGNLGRAVFQAKKRVLEPLG-LVEEGAKTA
hu.44-A    71  AALEHDKAYDQQLKAGDNPYLKYNHADAEFQERLKEDTSFGGNLGRAVFQAKKRVLEPLG-LVEEGAETA
hu.43-A    71  AALEHDKAYDQQLKAGDNPYPRYNHADAEFQERLQEDTPFGGNLGRAVFQAKKRVLEPLG-LVEEAAKTA
AAV6-A     71  AALEHDKAYDQQLKAGDNPYLRYNHADAEFQERLQEDTSFGGNLGRAVFQAKKRVLEPFG-LVEEGAKTA
hu.34-B    71  AALEHDKAYDRQLDSGDNPYLKYNHADAEFQERLKEDTSFGGNLGRAVFQAKKRVLEPLG-LVEEPVKTA
hu.47-B    71  AALEHDKAYDRQLDSGDNPYLKYNHADAEFQERLKEDTSFGGNLGRAVFQAKKRVLEPLG-LVGEPVKTA
hu.29-B    71  AALEHDKAYDRQLDSGDNPYLKYNHADAEFQERLKEDTSFGGNLGRAVFQAKKRVLEPLG-LVEEPVKTA
hu.63-B    71  AALEHDKAYDRQLDSGDNPYPKYNHADAEFQERLKEDTSFGGNLGRAVFQAKKRVLEPLG-LVEEPVKTA
hu.56-B    71  AALEHDKAYDRQLDSGDNPYLKYNHADAEFQERLKEDTSFGGNLGRAVFQAKKRVLEPLG-LVEEPVKTA
hu.45-B    71  AALEHDKAYDRQLDSGDNPYLKYNHADAEFQERLKEDTSFGGNLGRAVFQAKKRVLEPLG-LVEEPVKTA
hu.57-B    70  AALEHDKAYDRQLDSGDNPYLKYNHADAEFQERLKEDTSFGGNLGRAVFQAKKRVLEPLG-LVGEPVKTA
hu.35-B    71  AALEHDKAYDRQLDSGDNPYLKYNHADAEFQERLKEDTSFGGNLGRAVFQAKKRVLEPLS-LVEEPVKTA
hu.58-B    71  AALEHDKAYDRQLDSGDNPYLKYNHADAEFQERLKEDTSFGGNLGRAVFQAKKRVLEPLG-LVEEPVKTA
hu.28-B    71  AALEHDKAYDRQLDSGDNPYLKYNHADAEFQERLKEDTSFGGNLGRAVFQAKKRVLEPLG-LVEEPVKTA
hu.51-B    71  AALEHDKAYDRQLDSGDNPYLKYNHADAEFQERLKEDTSFGGNLGRAVFQAKKRVLEPLG-LVGEPVKTA
hu.19-B    71  AALEHDKAYDRQLDSGDNPYLKYNHADAEFQERLKEDTSFGGNLGRAVFQAKKRILEPLG-LVEEPVKTA
hu.49-B    71  AALEYDKAYDRQLDSGDNPYLKYNHADAEFQERLKEDTSFGGNLGRAVFQAKKRILEPLG-LVEEPVKTA
hu.52-B    71  AALEHDKAYDRQLDSGDNPYLKYNHADAEFQERLKEDTSFGGNLGRAVFQAKKRVLEPLG-LVGEPVKTA
hu.13-B    71  AALEHDKAYDRQLDSGDNPYLKYNHADAEFQERLKEDTSFGGNLGRAVFQAKKRVLEPLG-LVEEPVKTA
AAV2-B     71  AALEHDKAYDRQLDSGDNPYLKYNHADAEFQERLKEDTSFGGNLGRAVFQAKKRVLEPLG-LVEEPVKAA
hu.20-B    71  AALEHDKAYDRQLDSGDNPYLKYNHVDAEFQERLKEDTSFGGNLGRAVFQAKKRILEPLG-LVEEPVKTA
hu.24-B    71  AALEHDKAYDRQLDSGDNPYLKYNHADAEFQERLKEDTSFGGNLGRAVFQAKKRILEPLG-LVEEPVKTA
hu.64-B    71  AALEHDKAYDRQLDGGDNPYLKYNHADAEFQERLKEDTSFGGNLGRAVFQAKKRILEPLG-LVEEPVKTA
hu.27-B    71  AALEHDKAYDRQLDSGDNPYLKYNHADAEFQERLKEDTSFGGNLGRAVFQAKKRILEPLG-LVEEPVKTA
hu.21-B    71  AALEHDKAYDRQLDSGDNPYLKYNHADAEFQERLKEDTSFGGNLGRAVFQAKKRILEPLG-LVEEPVKTA
hu.22-B    71  AALEHDKAYDRQLDSGDNPYLKYNHADAEFQERLKGDTSFGGNLGRAVFQAKKRILEPLG-LVEEPVKTA
hu.23-B    71  AALEHDKAYDRQLDSGDNPYLKYNHADAEFQERLKEDTSFGGNLGRAVFQAKKRILEPLG-LVEEPVKTA
hu.7-C     71  AALEHDKAYDRQLDSGDNPYLKYNHADAEFQERLKEDTSFGGNLGRAVFQAKKRVLEPLG-LVEEPVKTA
hu.61-C    71  AALEHDKAYDRQLDSGDNPYLKYNHADAEFQERLKEDTSFGGNLGRAVFQAKKRVLEPLG-LVEGPVKTA
rh.56-C    71  AALEHDKAYDRQLDSGDNPYLKYNHADAEFQERLKEDTSFGGNLGRAVFQAKKRVLEPLG-LVEEPVKTA
```

FIG. 2D

| | | |
|---|---|---|
| hu.9-C | 71 | AALEHDKAYDRQLDSGDNPYLKYNHADAEFQERLKEDTSFGGNLGRAVFQAKKRVLEPLG-LVEEPVKTA |
| hu.54-C | 71 | AALEHDKAYDRQLDSGDNPYLKYNHADAEFQERLKEDTSFGGNLGRAVFQAKKRVLEPLG-LVEEPVKTA |
| hu.53-C | 71 | AALEHDKAYDRQLDSGDNPYLKYNHADAEFQERLKEDTSFGGNLGRAVFQAKKRVLEPLG-LVEEPVKTA |
| hu.60-C | 71 | AALEHDKAYDRQLDSGDNPYLKYNHADAEFQERLKEDTSFGGNLGRAVFQAKKRVLEPLG-LVEEPVKTA |
| hu.55-C | 71 | AALEHDKAYDRQLDSGDNPYLKYNHADAEFQERLKEDTSFGGNLGRAVFQAKKRVLEPLG-LVEEPVKTA |
| hu.2-C | 71 | AALEHDKAYDRQLDSGDNPYLKYNHADAEFQERLKEDTSFGGNLGRAVFQAKKRVLEPLG-LVEEPVKTA |
| hu.1-C | 71 | AALEHDKAYDRQLDSGDNPYLKYNHADAEFQERLKEDTSFGGNLGRAVFQAKKRVLEPLG-LVEEPVKTA |
| hu.18-C | 71 | AALEHDKAYDRQLESGDNPYLKYNHADAEFQERLKEDTSFGGNLGRAVFQAKKRVLEPLG-LVEEPVKTA |
| hu.3-C | 71 | AALEHDKAYDRQLDSGDNPYLKYNHADAEFQERLKEDTSFGGNLGRAVFQAKKRVLEPLRPGLRKPVKTA |
| hu.25-C | 71 | AALEHDKAYDRQLNSGDNPYLKYNHADAEFQERLKEDTSFGGNLGRAVFQAKKRVLEPLG-LVEEPVKTA |
| hu.15-C | 71 | AALEHDKAYDRQLDSGDNPYLKYNHADAEFQERLKEDTSFGGNLGRAVFQAKKRVLEPLG-LVGEPVKTA |
| hu.16-C | 71 | AALEHDKAYDRQLDSGDNPYLKYNHAGAEFQERLKEDTSFGGNLGRAVFQAKKRVLEPLG-LVEEPVKTA |
| hu.11-C | 71 | AALEHDKAYDRQLDSGDNPYLKYNHADAEFQERLKEDTSFGGNLGRAVFQAKKRVLEPLG-LVEEPVKTA |
| hu.10-C | 71 | AALEHDKAYDRQLDSGDNPYLKYNHADAEFQERLKEDTSFGGNLGRAVFQAKKRVLEPLG-LVEEPVKTA |
| hu.4-C | 71 | AALEHDKAYDRQLDSGDNPYLKYNHADAEFQERLKEDTSFGGNLGRAVFQAKKRVLEPLG-LVEEPVKTA |
| rh.54-D | 71 | AALEHDKAYDQQLKAGDNPYLRYNHADAEFQERLQEDTSFGGNLGRAVFQAKKRVLEPLG-LVEEAAKTA |
| rh.48-D | 71 | AALEHDKAYDQQLKAGDNPYLRYNHADAEFQERLQEDTSFGGNLGRAVFQAKKRVLEPLG-LVEEAAKTA |
| rh.55-D | 71 | AALEHDKAYDQQLKAGDNPYLRYNHADAEFQERLQEDTSFGGNLGRAVFQAKKRVLEPLG-LVEEGAKTA |
| rh.62-D | 71 | AALEHDKAYDQQLKAGDNPYLRYNHADAEFQERLQEDTSFGGNLGRAVFQAKKRVLEPLG-LVEEGAKTA |
| AAV7-D | 71 | AALEHDKAYDQQLKAGDNPYLRYNHADAEFQERLQEDTSFGGNLGRAVFQAKKRVLEPLG-LAEEAAKTA |
| rh.52-E | 71 | AALEHDKAYDQQLKAGDNPYLRYNHADAEFQERLQEDTSFGGNLGRAVFQAKKRVLEPLG-LVEEGAKTA |
| rh.51-E | 71 | AALEHDKAYDQQLKAGDNPYLRYNHADAEFQERLQEDTSFGGNLGRAVFQAKKRVLEPLG-LVEEGAKTA |
| rh.39-E | 71 | AALEHDKAYDQQLKAGDNPYLRYNHADAEFQERLQEDTSFGGNLGRAVFQAKKRVLEPLG-LVEEGAKTA |
| rh.53-E | 71 | AALEHDKAYDQQLKAGDNPYLRYNHADAEFQERLQEDTSFGGNLGRAVFQAKKRVLEPLG-LVEEGAKTA |
| hu.37-E | 71 | AALEHDKAYDQQLKAGDNPYLRYNHADAEFQERLQEDTSFGGNLGRAVFQAKKRVLEPLG-LVEEAAKTA |
| hu.43-E | 71 | AALEHDKAYDQQLKAGDNPYLRYNHADAEFQERLQEDTSFGGNLGRAVFQAKKRVLEPLG-LVEEAAKTA |
| rh.50-E | 71 | AALEHDKAYDQQLKAGDNPYLRYNHADAEFQERLQEDTSFGGNLGRAVFQAKKRVLEPLG-LVEEGAKTA |
| hu.49-E | 71 | AALEHDKAYDQQLKAGDNPHLRYNHADAEFQERLQEDTSFGGNLGRAVFQAKKRVLEPLG-LVEEGAKTA |
| rh.61-E | 71 | AALEHDKAYDQQLKAGDNPYLRYNHADAEFQERLQEDTSFGGNLGRAVFQAKKRVLEPLG-LVEEGAKTA |
| hu.41-E | 71 | AALEHDKAYDQQLKAGDNPYLRYNHADAEFQERLQEDTSFGGNLGRAVFQAKKRVLEPLG-PVEEAAKTA |

```
rh.64-E    71 AALEHDKAYDQQLKAGDNPYLRYNHADAEFQERLQEDTSFGGNLGRAVFQAKKRVLEPLG-LVEEGAKTA
hu.42-E    71 AALEHDKAYDQQLKAGDNPYLRYNHADAEFQERLQEDTSFGGNLGRAVFQAKKRVLEPLG-LVEEAAKTA
rh.57-E    71 AALEHDKAYDQQLKAGDNPYLRYNHADAEFQERLQEDTSFGGNLGRAVFQAKKRVLEPLG-LVEEGAKTA
rh.40-E    71 AALEHDKAYDQQLQAGDNPYLRYNHADAEFQERLQEDTSFGGNLGRAVFQAKKRVLEPLG-LVEEAAKTA
AAV8-E     71 AALEHDKAYDQQLKAGDNPYLRYNHADAEFQERLQEDTSFGGNLGRAVFQAKKRVLEPLG-LVEEGAKTA
rh.58-E    71 AALEHDKAYDQQLKAGDNPYLRYNHADAEFQERLQEDTSFGGNLGRAVFQAKKRVLEPLG-LVEEAAKTA
rh.40-E    71 AALEHDKAYDQQLQAGDNPYLRYNHADAEFQERLQEDTSFGGNLGRAVFQAKKRVLEPLG-LVEEAAKTA
hu.67-E    71 AALEHDKAYDQQLKAGDNPYLRYNHADAEFQERLQEDTSFGGNLGRAVFQAKKRVLEPLG-LVEEGAKTA
hu.17-E    71 AALEHDKAYDQQLKAGDNPYLRYNHADAEFQERLQEDTSFGGNLGRAVFQAKKRVLEPLG-LVEEAAKTA
hu.6-E     71 AALEHDKAYDQQLKAGDNPYLRYNHADAEFQERLQEDTSFGGNLGRAVFQAKKRVLEPLG-LVEEAAKTA
hu.66-E    71 AALEHDKAYDQQLKAGDNPYLRYNHADAEFQERLQEDTSFGGNLGRAVFQAKKRVLEPLG-LVEEAAKTA
rh.38-E    71 AALEHDKAYDQQLKAGDNPYLRYNHADAEFQERLQEDTSFGGNLGRAVFQAKKRVLEPLG-LVEEAAKTA
hu.32-F    71 AALEHDKAYDQQLKAGDNPYLKYNHADAEFQERLKEDTSFGGNLGRAVFQAKKRLLEPLG-LVEEAAKTA
AAV9/hu    71 AALEHDKAYDQQLKAGDNPYLKYNHADAEFQERLKEDTSFGGNLGRAVFQAKKRLLEPLG-LVEEAAKTA
hu.31-F    71 AALEHDKAYDQQLKAGDNPYLKYNHADAEFQERLKEDTSFGGNLGRAVFQAKKRLLEPLG-LVEEAAKTA 150        160        170        180        190        200       210
                ....|....|....|....|....|....|....|....|....|....|....|....|....|....|

AAV5      139 PTGKRIDDHFP-------KRKKARTEEDSKPSTSSDAEAGPSGSQQLQIPAQPASSLGADTMSAGG
AAV3-3    140 PGKKGAVDQSPQ-EPDSSGVGKSGKQPARKRLNFGQTGDSESVPD-PQPLGEPPAAPTSLGSNTMASGG
AAV4-4    139 PGKKRPLIESPQ-QPDSSTGIGKKGKQPAKKKLVFEDETGAGDGP-----PEGSTSGAMS--DDSEMRAAA
AAV1-A    140 PGKKRPVEQSPQ-EPDSSSGIGKTGQQPAKKRLNFGQTGDSESVPD-PQLGEPPATPAAVGPTTMASGG
hu.46-A   140 PGKKRPVEQSPQ-EPDSPSGIGKTGQQPAKKRLNFGQTGDSESVPD-PQPLGEPPATPAAVGPTTMASGG
hu.48-A   140 PGKKRPVEQSPQ-EPDSSSGIGKTGQQPAKKRLNFGQTGDSESVPD-PQPLGEPPATPAAVGPTTMASGG
hu.44-A   140 PGKKRPVEQSPQ-GPDSSSGIGKTGQQPAKKRLNFGQTGDSESVPD-PQPLGEPPATPAAVGPTTMASGG
hu.43-A   140 PGKKRPVEPSPQRSPDSSTGIGKKGQQPAKKRLNFGQTGDSESVPD-PQPIGEPPAGPSGLGSGTMAAGG
AAV6-A    140 PGKKRPVEPSPQRS-EPDSSSGIGKTGQQPAKKRLNFGQTGDSESVPD-PQPLGEPPATPAAVGPTTMASGG
hu.34-B   140 PGKKRPVEHSPV-EPDSSSGTGKAGQQPARKRLNFGQTGDADSVPD-PQPLGQPPAAPSGLGTNTMATGS
hu.47-B   140 PGKKRPVEHSPV-EPDSSSGTGKAGQQPARKRLNFGQTGDADSVPD-PQPLGQPPAAPSGLGTNTMATGS
hu.29-B   140 PGKKRPVEHSPA-EPDSSSGTGKSGNQPARKRLNFGQTGDSDSVPD-PQPLGQPPAAPSGLGTNTMATGS
```

```
hu.63-B   140  PGKKRPVEHSPA-EPDSSSGTGKAGQQPARKRLNFGQTGDADSVPD-PQPLGQPPAAPSGLGTNTMATGS
hu.56-B   140  PGKKRPVEHSPV-EPDSSSGTGKAGNQPARKRLNFGQTGDADSVPD-PQPLGQPPAASPSGLGTNTMATGS
hu.45-B   140  PGKKRPVEHSPV-EPDSSSGTGKAGNQPARKRLNFGQTGDADSVPD-PQPLGQPPAAPSGLGTNTMATGS
hu.57-B   139  PGKKRPVEHSPV-EPDSSSGTGKAGNQPARKRLNFGQTGDADSVPD-PQPLGQPPAAPSGLGTNTMATGS
hu.35-B   140  PGKKRPVEHSPV-EPDSSSGTGKAGNQPARKRLNFGQTGDADSVPD-PQPLGQPPAAPSGLGTNTMATGS
hu.58-B   140  PGKKRPVEHSPV-EPDSSSGTGKAGNQPARKRLNFGQTGDADSVPD-PQPLGQPPAAPSGLGTNTMATGS
hu.28-B   140  PGKKRPVEHSPA-EPDSSSGTGKAGNQPARKRLNFGQTGDADSVPD-PQPLGQPPAAPSGLGTNTMATGS
hu.51-B   140  PGKKRPVEHSPA-EPDSSSGTGKSGNQPARKRLNFGQTGDSDSVPD-PQPLGQPPAAPSGLGTNTMATGS
hu.19-B   140  PGEKRPVEHSPV-EPDSSSGTGKAGQQPARKRLNFGQTGDADSVPD-PQPLGQPPAAPSGLGTNTMASGS
hu.49-B   140  PGKKRPVEHSPV-EPDSSSGTGKAGQQPARKRLNFGQTGDADSVPD-PQPLGQPPAAPSGLGTNTMATGS
hu.52-B   140  PGKKRPVEHSPV-EPDSSSGTGKAGQQPARKRLNFGQTGDADSVPD-PRPLGQPPAAPSGLGTNTMASGS
hu.13-B   140  PGKKRPVEHSPA-EPDSSSGTGKAGQQPARKRLNFGQTGDADSVPD-PQPLGQPPAAPSGLGTNTMATGS
AAV2-B    140  PGKKRPVEHSPV-EPDSSSGTGKAGQQPARKRLNFGQTGDADSVPD-PQPLGQPPAAPSGLGTNTMATGS
hu.20-B   140  PGKKRPVEHSPV-EPDSSSGTGKAGQQPARKRLNFGQTGDADSVPD-PQPLGQPPAAPSGLGTNTMATGS
hu.24-B   140  PGKKRPVEHSPV-EPDSSSGTGKAGQQPARKRLNFGQTGDADSVPD-PQPLGQPPAAPSGLGTNTMATGS
hu.64-B   140  PGKKRPVEHSLA-EPDSSSGTGKAGQQPARRRLNFGQTGDADSVPD-PQPLGQPPAAPSGLGTNTMATGS
hu.27-B   140  PGKKRPVEHSPA-EPDSSSGTGKAGQQPARKRLNFGQTGDADSVPD-PQPLGQPPAAPSGLGTNTMATGS
hu.21-B   140  PGKKRPVEHSPA-EPDSSSGTGKAGQQPARKRLNFGQTGDADSVPD-PRPLGQPPAAPSGLGTNTMASGS
hu.22-B   140  PGKKRPVEHSPA-EPDSSSGTGKAGQQPARKRLNFGQTGDADSVPD-PQPLGQPPAAPSGLGTNTMASGS
hu.23-B   140  PGKKRPVEHSPA-EPDSSSGTGKAGQQPARKRLNFGQTGDADSVPD-PQPLGQPPAAPSGLGTNTMASGS
hu.7-C    140  PGKKRPVEHSPV-EPDSSSGTGKAGQQPARKRLNFGQTGDADSVPD-PQPLGQPPAAPSGLGSTTMATGS
hu.61-C   140  PGKKRPVEHPPV-EPDSSSGTGKAGQQPARKRLNFGQTGDADSVPD-PQPLGQPPAAPSGLGSTTMATGS
rh.56-C   140  PGKKRPVEHSPA-EPDSSSGTGKAGQQPARKRLNFGQTGDADSVPD-PQPLGQPPAAPSGLGSTTMATGS
hu.9-C    140  PGKKRPVEHSPV-EPDSSSGTGKAGHQPARKRLNFGQTGDADSVPD-PQPLGQPPAAPTSLGSTTMATGS
hu.54-C   140  PGKKRPVEHSPA-EPDSSSGTGKAGQQPARKRLNFGQTGDADSVPD-PQPLGQPPAAPTSLGSTTMATGS
hu.53-C   140  PGKKRPVEHSPV-EPDSSSGTGKAGQQPARKRLNFGQTGDADSVPD-PQPLRQPPAAPTSLGSTTMATGS
hu.60-C   140  PGKKRPVEHSPV-EPDSSSGTGKAGQQPARKRLNFGQTGDADSVPD-PQPLGQPPAAPSGLGSTTMATGS
hu.55-C   140  PGKKRPVEHSPA-EPDSSSGTGKAGQQPARKRLNFGQTGDADSVPD-PQPLGQPPAAPTSLGSTTMATGS
hu.2-C    140  PGKKRPVEHSPV-EPDSSSGTGKAGQRPARKRLNFGQTGDADSVPD-PQPLGQPPAAPSGLGSTTMATGS
hu.1-C    140  PGKKRPVEHSPV-EPDSSSGTGKAGQQPARKRLNFGQTGDADSVPD-PQPLGQPPAAPSGLGSTTMATGS
```

FIG. 2G

```
hu.18-C   140  PGKKRPVEHSPV-EPDSSSGTGKAGQQPARKRLNFGQTGDADSVPD-PQPLGQPPAAPSGLGSTTMASGS
hu.3-C    141  PGKKRPVEHSPV-EPDSSSGTGKAGQQPARKRLNFGQTGDADSVPD-PQPLGQPPAAPSGLGSTTMATGS
hu.25-C   140  PGKKRPVEHSPA-EPDSSSGTGKAGQQPARKRLNFGQTGDADSVPD-PQPLGQPPAAPSGLGSTTMATGS
hu.15-C   140  PGKKRPVEHSPV-EPDSSSGTGKAGNQPARKRLNFGQTGDADSVPD-PQPLGQPPAAPSGLGSTTMATGS
hu.16-C   140  PGKKRPVEHSPV-EPDSSSGTGKAGNQPARKRLNFGQTGDADSVPD-PQPLGQPPAAPSGLGSTTMATGS
hu.11-C   140  PGKKRPVEHSPV-EPDSSSGTGKAGHQPARKRLNFGQTGDADSVPD-PQPLGQPPAAPTSLGSTTMATGS
hu.10-C   140  PGKKRPVEHSPV-EPDSSSGTGKAGHQPARKRLNFGQTGDADSVPD-PQPLGQPPAAPTSLGSTTMATGS
hu.4-C    140  PGKKRPVEHSPV-EPDSSSGTGKAGQQPARKRLNFGQTGDADSVPD-PQPLGQPPAAPSGLGSTTMATGS
rh.54-D   140  PGKKRPVEPSPQRSPDSSSGTGIGKKGQQPARKRLNFGQTGDSESVPD-PQPLGEPPAGPSGLGSGTMAAGG
rh.48-D   140  PGKKRPVEPSPQRSPDSSTGIGKKGQQPARKRLNFGQTGDSESVPD-PQPLGEPPAGPSGLGSGTMAAGG
rh.55-D   140  PGKKRPVEPSPQRSPDSSTGIGKKGQQPARKRLNFGQTGDSESVPD-PQPIGEPPAAPSSVGSGTMAAGG
rh.62-D   140  PGKKRPVEPSPQRSPDSSTGIGKKGQQPARKRLNFGQTGDSESVPD-PQPIGEPPAGPSGLGSGTMAAGG
AAV7-D    140  PAKKRPVEPSPQRSPDSSTGIGKKGQQPARKRLNFGQTGDSESVPD-PQPLGEPPAAPSSVGSGTVAAGG
rh.52-E   140  PGKKRPVEPSPQRSPDSSTGIGKKGQQPAKKRLNFGQTGDSESVPD-PQPIGEPPAAPSSVGSGTMAAGG
rh.51-E   140  PGKKRPVEPSPQRSPDSSTGIGKKGQQPARKRLNFGQTGDSESVPD-PQPIGEPPAAPSSVGSGTMAAGG
rh.39-E   140  PGKKRPVEPSPQRSPDSSTGIGKKGQQPARKRLNFGRTGDSESVPD-PQPIGEPPAAPSSVGSGTMAAGG
rh.53-E   140  PGKKRPVEPSPQRSPDSSTGIGKKGQQPAKKRLNFGQTGDSESVPD-PQPIGEPPAAPSSVGSGTMAAGG
rh.37-E   140  PGKKRPVEPSPQRSPDSSTGIGKKGQQPAKKRLNFGQTGDSESVPD-PQPIGEPPAGPSGLGSGTMAAGG
rh.43-E   140  PGKKRPVEQSPQ-EPDSSSGIGKKGQQPAGKRLNFGQTGDSESVPD-PQPIGEPPAAPSSVGSGTMAAGG
rh.50-E   140  PGKKRPVEPSPQRSPDSSTGIGKKGQQPARKRLNFGQTGDSESVPD-PQLIGEPPAAPSSVGSGTMAAGG
rh.49-E   140  PGKKRPVEPSPQRSPDSSTGIGKKGQQPARKRLNFGQTGDSESVPD-PQPIGEPPAAPSSVGSGTMAAGG
rh.61-E   140  PGKKRPVEPSPQRSPDSSTGIGKKGQQPAKKRLNFGQTGDSESVPD-PQPIGEPPAGPSGLGSGTMAAGG
hu.41-E   140  PGKKRPVEPPPQRSPDSSTGIGKKGQQPAKKRLNFGQTGDSESVPD-PQPIGEPPAAPSSVGSGTMAAGG
rh.64-E   140  PGKKRPVEPSPQRSPDSSTGIGKKGQQPAKKRLNFGQTGDSESVPD-PQPIGEPPAGPSGLGSGTMAAGG
hu.42-E   140  PGKKRPVEPSPQRSPDSSTGIGKKGQQPAKKRLNFGQTGDSESVPD-PQPIGEPPAGPSGLGSGTMAAGG
rh.57-E   140  PGKKRPVEPSPQRSPDSSTGIGKKGQQPARKRLNFGQTGDSESVPD-PQPIGEPPAAPSSVGSGTMAAGG
hu.40-E   140  PGKKRPVEPSPQRSPDSSTGIGKKGQQPAKKRLSFGQTGDSESVPD-PQPIGEPPAGPSGLGSGTMAAGG
AAV8-E    140  PGKKRPVEPSPQRSPDSSTGIGKKGQQPAKKRLNFGQTGDSESVPD-PQPIGEPPAAPSSVGSGVPNTMAAGG
rh.58-E   140  PGKKRPVEPSPQRSPDSSTGIGKKGQQPAKKRLNFGQTGDSESVPD-PQPIGEPPAAPSSVGSGVPNTMAAGG
rh.40-E   140  PGKKRPVEPSPQRSPDSSTGIGKKGQQPAKKRLNFGQTGDSESVPD-PQPIGEPPAGPSGLGSGTMAAGG
```

FIG. 2H

```
hu.67-E   140 PGKKRPVEPSPQRSPDSSTGIGKKGQQPAKKRLNFGQTGDSESVPD-PQPIGEPPAGPSGLGSGTMAAGG
hu.17-E   140 PGKKRPVEPSPQRSPDSSTGIGKKGQQPAKKRLNFGQTGDSESVPD-PQPIGEPPAGPSGLGSGTMAAGG
hu.6-E    140 PGKKRPVEPSPQRSPDSSTGIGKTGQQPAKKRLNFGQTGDSESVPD-PQPIGEPPAGPSGLGSGTMAAGG
hu.66-E   140 PGKKRPVEPSPQRSPDSSAGIGKKGQQPAKKRLNFGQTGDSESVPD-PQPIGEPPAGPSGLGSGTMAAGG
hu.38-E   140 PGKKRPVEPSPQRSPDSSTGIGKKGQRPAKKRLNFGQTGDSESVPD-PQPIGEPPAGPSGLGSGTMAAGG
rh.38-E   140 PGKKRPVEQSPQ-EPDSSAGIGKSGSGSQPAKKKLNFGQTGDTESVPD-PQPIGEPPAAPSGVGSLTMASGG
hu.32-F   140 PGKKRPVEQSPQ-EPDSSAGIGKSGAQPAKKRLNFGQTGDTESVPD-PQPIGEPPAAPSGVGSLTMASGG
AAV9/hu   140 PGKKRPVEQSPQ-EPDSSAGIGKSGSQPAKKRLNFGQTGDTESVPD-PQPIGEPPAAPSGVGSLTMASGG
hu.31-F   140 PGKKRPVEQSPQ-EPDSSAGIGKSGSGSQPAKKRLNFGQTGDTESVPD-PQPIGEPPAAPSGVGSLTMASGG 220         230         240         250         260         270         280
                     |....|....|....|....|....|....|....|....|....|....|....|....|....|

AAV5      198 GGPLGDNNQGADGVGNASGDWHCDSTWMGDRVVTKSTRTWVLPSYNNHQYREIKS-GSVDGSNANAYFGY
AAV3-3    208 GAPMADNNEGADGVGNSSGNWHCDSQWLGDRVITTSRTWALPTYNNHLYKQIS--SQSGASNDNHYFGY
AAV4-4    202 GGAAVEGGQGADGVGNASGDWHCDSTWSEGHVTTSTRTWVLPTYNNHLYKRLG----ESLQSNTYNGF
AAV1-A    208 GAPMADNNEGADGVGNASGNWHCDSTWLGDRVITTSTRTWALPTYNNHLYKQIS--ASTGASNDNHYFGY
hu.46-A   208 GAPMADNNEGADGVGNASGNWHCDSTWLGDRVITTSTRTWALPTYNNHLYKQISS-ASTGASNDNHYFGY
hu.48-A   208 GAPMADNNEGADGVGNASGNWHCDSTWLGDRVITTSTRTWALPTYNNHLYKQISS-ASTGASNDNHYFGY
hu.44-A   208 GAPMADNNEGADGVGNASGNWHCDSTWLGDRVITTSTRTWALPTYNNHLYKQISS-TSTGASNDNHYFGY
hu.43-A   209 GAPMADNNEGADGVGNASGNWHCDSTWLGDRVITTSTRTWALPTYNNHLYKQISS-ASTGASNDNHYFGY
AAV6-A    208 GAPMADNNEGADGVGNASGNWHCDSTWMGDRVITTSTRTWALPTYNNHLYKQISS-ASTGASNDNHYFGY
hu.34-B   208 GAPMADNNEGADGVGNSSGNWHCDSTWMGDRVITTSTRTWALPTYNNHLYKQIS--SQSGASNDNHYFGY
hu.47-B   208 GAPMADNNEGADGVGNSSGNWHCDSTWMGDRVITTSTRTWALPTYNNHLYKQIS--SQSGASNDNHYFGY
hu.29-B   208 GAPMADNNEGADGVGNSSGNWHCDSTWMGDRVITTSTRTWALPTYNNHLYKQIS--SQSGASNDNHYFGY
hu.63-B   208 GAPMADNNEGADGVGNSSGNWHCDSTWMGDRVITTSTRTWALPTYNNHLYKQIS--SQSGASNDNHYFGY
hu.56-B   208 GAPMADNNEGADGVGNSSGNWHCDSTWMGDRVITTSTRTWALPTYNNHLYKQIS--SQSGASNDNHYFGY
hu.45-B   208 GAPMADNNEGADGVGNSSGDWHCDSTWMGDRVITTSTRTWALPTYNNHLYKQIS--SQSGASNDNHYFGY
hu.57-B   207 GAPMADNNEGADGVGNSSGNWHCDSTWMGDRVITTSTRTWALPTYNNHLYKQIS--SQSGASNDNHYFGY
hu.35-B   208 GAPMADNNEGADGVGNSSGNWHCDSTWMGDRVITTSTRTWALPTYNNHLYKQIS--SQSGASNDNHYFGY
hu.58-B   208 GAPMADNNDGADGVGNSSGNWHCDSTWMGDRVITTSTRTWALPTYNNHLYKQIS--SQSGASNDNHYFGY
hu.28-B   208 GAPMADNNEGADGVGNSSGNWHCDSTWMGDRVITTSTRTWALPTYNNHLYKQIS--SQSGASNDNHYFGY
```

FIG. 21

| | | |
|---|---|---|
| hu.51-B | 208 | GAPMADNNEGADGVGNSSGNWHCDSTWMGDRVITTSTRTWALPTYNNHLYKQIS--SQSGASNDNHYFGY |
| hu.19-B | 208 | GAPMADNNEGADGVGNSSGNWYCDSTWMGDRVITTSTRTWALPTYNNHLYKQIS--SQSGASNDNHYFGY |
| hu.49-B | 208 | GAPMADNNEGADGVGNSSGSWHCDSTWMGDRVITTSTRTWALPTYNNHLYKQIS--SQSGASNDNHYFGY |
| hu.52-B | 208 | GAPMADNNEGADGVGNSSGNRHCDSTWMGDRVITTSTRTWALPTYNNHLYKQIS--SQSGASNDNHYFGY |
| hu.13-B | 208 | GAPMADNNEGADGVGNSSGNWHCDSTWMGDRVITTSTRTWALPTYNNHLYKQIS--SQSGASNDNHYFGY |
| AAV2-B | 208 | GAPMADNNEGADGVGNSSGNWHCDSTWMGDRVITTSTRTWALPTYNNHLYKQIS--SQSGASNDNHYFGY |
| hu.20-B | 208 | GAPMADNNEGADGVGNSSGNWHCDSTWMGDRVITTSTRTWALPTYNNHLYKQIS--SQSGASNDNHYFGY |
| hu.24-B | 208 | GAPMADNNEGADGVGNSSGNWHCDSTWMGDRVITTSTRTWALPTYNNHLYRQIS--SQSGASNDNHYFGY |
| hu.64-B | 208 | GAPMADNNEGADGVGNSSGNWHCDSTWMGDRVITTSTRTWALPTYNNHLYRQIS--SQSGASNDNHYFGY |
| hu.27-B | 208 | GAPMADNNEGADGVGNSSGNWHCDSTWMGDRVITTSTRTWALPTYNNHLYKQIS--SQSGASNDNHYFGY |
| hu.21-B | 208 | GAPMADNNEGADGVGNSSGNWHCDSTWMGDRVITTSTRTWALPTYNNHLYKQIS--SQSGASNDNHYFGY |
| hu.22-B | 208 | GAPMADNNEGADGVGNSSGNWHCDSTWMGGRVITTSTRTWALPTYNNHLYKQIS--SQSGASNDNHYFGY |
| hu.23-B | 208 | GAPMADNNEGADGVGNSSGNWHCDSTWMGDRVITTSTRTWALPTCNNHLYKQIS--SQSGASNDNHYFGY |
| hu.7-C | 208 | GAPMADNNEGADGVGNSSGNWHCDSQWLGDRVITTSTRTWALPTYNNHLYKQIS--SQSGASNDNHYFGY |
| hu.61-C | 208 | GAPMADNNEGADGVGNSSGNWHCDSQWLGDRVITTSTRTWALPTYNNHLYKQIS--SQSGASNDNHYFGY |
| rh.56-C | 208 | GAPMADNNEGADGVGNSSGNWHCDSQWLGDRVITTSTRTWAQPTYNNHLYKQIS--SQSGASNDNHYFGY |
| hu.9-C | 208 | GAPMADNNEGADGVGNSSGNWHCDSQWLGDRVITTSTRTWALPTYNNHLYKQIS--SQSGASNDNHYFGC |
| hu.54-C | 208 | GAPMADNNEGADGVGNSSGNWHCDSQWLGDRVITTSTRTWALPTYNNHLYKQIS--SQSGASNDNHYFGY |
| hu.53-C | 208 | GAPMADNNEGADGVGNSSGNWHCDSQWLGDRVITTSTRTWALPTYNNHLYKQIS--SQSGASNDNHYFGY |
| hu.60-C | 208 | GAPMADNNEGADGVGNSSGNWHCDSQWLGDRVITTSTRTWALPTYNNHLYKQIS--SQSGASNDNHYFGY |
| hu.55-C | 208 | GAPMADNNEGADGVGNSSGNWHCDSQWLGDRVITTSTRTWALPTYNNHLYKQIS--SQSGASNDNHYFGY |
| hu.2-C | 208 | GAPMADNNEGADGVGNSSGNWHCDSQWLGDRVITTSTRTWALPTYNNHLYKQIS--SQSGASNDNHYFGY |
| hu.1-C | 208 | GAPMADNNEGADGVGNSSGNWHCDSQWLGDRVITTSTRTWALPTYNNHLYKQIS--SQSGASNDNHYFGY |
| hu.18-C | 208 | GAPMADNNEGADGVGNSSGNWHCDSQWLGDRVITTSTRTWALPTYNNHLYKQIS--SQSGASNDNHYFGY |
| hu.3-C | 209 | GAPVADNNEGADGVGNSSGNWHCDSQWLGDRVITTSTRTWALPTYNNHLYKQIS--SQSGASNDNHYFGY |
| hu.25-C | 208 | GAPVADNNEGADGVGNSSGNWHCDSQWLGDRVITTSTRTWALPTYNNHLYKQIS--SQSGASNDNHYFGY |
| hu.15-C | 208 | GAPVADNNEGADGVGNSSGNWHCDSQWLGDRVIATSTRTWALPTYNNHLYKQIS--SQSGACNDNHYFGY |
| hu.16-C | 208 | GAPVADNNEGADGVGNSSGNWHCDSQWLGDRVITTSTRTWALPTYNNHLYKQIS--SQSGASNDNHYFGY |
| hu.11-C | 208 | GAPMADNNEGADGVGNSSGNWHCDSQWLGDRVITTSTRTWALPTYNNHLYKQIS--SQSGASNDNHYFGY |
| hu.10-C | 208 | GAPMADNNEGADGVGNSSGNWHCDSQWLGDRVITTSTRTWALPTYNNHLYKQIS--SQSGASNDNHYFGY |

FIG. 2J

```
hu.4-C    208 GAPMADNNEGADGVGNSSGNWHCDSQWLGDRVITTSTRTWALPTYNNHLYKQIS--SQSGASNDNHYFGY
rh.54-D   209 GAPMADNNEGADGVGNASGNWHCDSTWLGDRVITTSTRTWALPTYNNHLYKQISS-QSAGSTNDNVFGY
rh.48-D   209 GAPMADNNKGADGVGNASGNWHCDSTWLGDRVITTSTRTWALPTYNNHLYKQISS-QSAGSTNDNVFGY
rh.55-D   209 GAPMADNNEGADGVGNASGNWHCDSTRLGDRVITTSTRTWALPTYNNHLYKQISS-QSAGSTNDNVFGY
rh.62-D   209 GAPMADNNEGADGVGNASGNWHCDSTWLGDRVITTSTRTWALPTYNNHLYKQISS-QSAGSTNDNVFGY
AAV7-D    209 GAPMADNNKGADGVGNASGNWHCDSTWLGDRVITTSTRTWALPTYNNHLYKQISS-ETAGSTNDNTYFGY
rh.52-E   209 GAPMADNNEGADGVGSSSGNWHCDSTWLGDRVITTSTRTWALPTYNNHLYKQISNGTSGGSTNDNTYFGY
rh.51-E   209 GAPMADNNEGADGVGSSSGNWHCDSTWLGDRVITTSTRTWALPTYNNHLYKQISNGTSGGSTNDNTYFGY
rh.39-E   209 GAPMADNNEGADGVGSSSGNWHCDSTWLGDRVITTSTRTWALPTYNNHLYKQISNGTSGGSTNDNTYFGY
hu.39-E   209 GAPMADNNEGADGVGSSSGNWHCDSTWLGDRVITTSTRTWALPTYNNHLYKQISNGTSGGSTNDNTYFGY
rh.53-E   209 GAPMADNNEGADGVGSSSGNWHCDSTWLGDRVITTSTRTWALPTYNNHLYKQISNGTSGGSTNDNTYFGY
rh.37-E   209 GAPMADNNEGADGVGSSSGNWHCDSTWLGDRVITTSTRTWALPTYNNHLYKQISNGTSGGSTNDNTYFGY
rh.43-E   208 GAPMADNNEGADGVGSSSGNWHCDSTWLGDRVITTSTRTWALPTYNNHLYKQISNGTSGGATNDNTYFGY
rh.50-E   209 GAPMADNNEGADGVGSSSGNWHCDSTWLGDRVITTSTRTWALPTYNNHLYKQISNGTSGGSTNDNTYFGY
rh.49-E   209 GAPMADNNEGADGVGSSSGNWHCDSTWLGDRVITTSTRTWALPTYNNHLYKQISNGTSGGSTNDNTYFGY
rh.61-E   209 GAPMADNNEGADGVGSSSGNWHCDSTWLGDRVITTSTRTWALPTYNNHLYKQISNGTSGGSTNDNTYFGY
rh.41-E   209 GAPMADNNEGADGVGSSSGNWHCDSTWLGDRVITTSTRTWALPTYNNHLYKQISNGTSGGSTNDNTYFGY
rh.64-E   209 GAPMADNNEGADGVGSSSGNWHCDSTWLGDRVITTSTRTWALPTYNNHLYKQISNGTSGGSTNDNTYFGY
rh.42-E   209 GAPMADNNEGADGVGSSSGNWHCDSTWLGDRVITTSTRTWALPTYNNHLYKQISNGTSGGSTNDNTYFGY
rh.57-E   209 GAPMADNNEGADGVGSSSGNWHCDSTWLGDRVITTSTRTWALPTYNNHLYKQTSNGTSGGSTNDNTYFGY
rh.40-E   209 GAPMADNNEGADGVGSSSGNWHCDSTWLGDRVITTSTRTWALPTYNNHLYKQISNGTSGGSTNDNTYFGY
hu.40-E   209 GAPMADNNEGADGVGSSSGNWHCDSTWLGDRVITTSTRTWALPTYNNHLYKQISNGTSGGSTNDNTYFGY
AAV8-E    209 GAPMADNNEGADGVGSSSGNWHCDSTWLGDRVITTSTRTWALPTYNNHLYKQISNGTSGGATNDNTYFGY
rh.58-E   209 GAPMADNNEGADGVGSSSGNWHCDSTWLGDRVITTSTRTWALPTYNNHLYKQISNGTSGGSTNDNTYFGY
rh.40-E   209 GAPMADNNEGADGVGSSSGNWHCDSTWLGDRVITTSTRTWALPTYNNHLYKQISNGTSGGSTNDNTYFGY
hu.67-E   209 GAPMADNNEGADGVGSSSGNWHCDSTWLGDRVITTSTRTWALPTYNNHLYKQISNGTSGGSTNDNTYFGY
hu.17-E   209 GAPMADNNEGADGVGSSSGNWHCDSTWLGDRVITTSTRTWALPTYNNHLYKQISNGTSGGSTNDNTYFGY
hu.6-E    209 GAPMADNNEGADGVGSSSGNWHCDSTWLGDRVITTSTRTWALPTYNNHLYKQISNGTSGGSTNDNTYFGY
hu.66-E   209 GAPMADNNEGADGVGSSSGNWHCDSAWLGDRVITTSTRPWALPTYNNHLYKQISNGTSGGSTNDNTYFGY
rh.38-E   209 GAPMADNNEGADGVGSSSGNWHCDSTWLGDRVITTSTRTWALPTYNNHLYKQISNSTSGGSSNDNAYFGY
rh.32-F   208 GAPVADNNEGADGVGSSSGNWHCDSQWLGDRVITTSTRTWALPTYNNHLYKQISNSTSGGSSNDNAYFGY
AAV9/hu   208 GAPVADNNEGADGVGSSSGNWHCDSQWLGDRVITTSTRTWALPTYNNHLYKQISNSTSGGSSNDNAYFGY
```

```
hu.31-F  208 GAPVADNNEGADGVGSSSGNWHCDSQWLGDRVITTSTRTWALPTYNNHLYKQISNSTSGGSSNDNAYFGY
                   290       300       310       320       330       340       350
             ....|....|....|....|....|....|....|....|....|....|....|....|....|....|
AAV5     267 STPWGYFDENREHSHWSPRDWQRLINNYWGFRPRSLRVKIFNIQVKEVTVQDSTTTIANNLTSTVQVFTD
AAV3-3   276 STPWGYFDENRFHCHFSPRDWQRLINNNWGFRPKKLSFKLFNIQVRGVTQNDGTTIANNLTSTVQVFTD
AAV4-4   267 STPWGYFDENREHCHFSPRDWQRLINNNWGMRPKAMRVKIFNIQVKEVTTSNGETTVANNLTSTVQIFAD
AAV1-A   277 STPWGYFDENRFHCHFSPRDWQRLINNNWGFRPKRLNFKLFNIQVKEVTTNDGVTTIANNLTSTVQVFSD
hu.46-A  277 STPWGYFDENRFHCHFSPRDWQRLINNNWGFRPKRLNFKLFNIQVKEVTTNDGVTTIANNLTSTVQVFSD
hu.48-A  277 GTPWGYFDENRFHCHFSPRDWQRLINNNWGFRPKRLNFKLFNIQVEEVTTNDGVTTIANNLTSTVQVFSD
hu.44-A  277 STPWGYFDENRFHCHFSPRDWQRLINNNWGFRPKRLNFKLFNIQVKEVTTNDGVTTIANNLTSTVQVFSD
hu.43-A  278 STPWGYFDENRFHCHFSPRDWQRLINNNWGFRPKRLNFKLFNIQVKEVTTNDGVTTIANNLTSTVQVFSD
AAV6-A   277 STPWGYFDENRFHCHFSPRDWQRLINNNWGFRPKRLNFKLFNIQVKEVTTNDGVTTIANNLTSTVQVFSD
hu.34-B  276 STPWGYFDENRFHCHFSPRDWQRLINNNWGFRPKRLNFKLFNIQVKEVTQNDGTTIANNLTSTVQVFTD
hu.47-B  276 STPWGYFDENRFHCHFSPRDWQRLINNNWGFRPKRLNFKLFNIQVKEVTQNDGTTIANNLTSTVQVFTD
hu.29-B  276 STPWGYFDENRFHCHFSPRDWQRLINNNWGFRPKRLNFKLFNIQVKEVTQNDGTTIANNLTSTVQVFTD
hu.63-B  276 STPWGYFDENRFHCHFSPRDWQRLINNNWGFRPKRLNFKLFNIQVKEVTQNDGTTIANNLTSTVQVFTD
hu.56-B  276 STPWGYFDENRFHCHFSPRDWQRLINNNWGFRPKRLNFKLFNIQVKEVTQNDGTTIANNLTSTVQVFTD
hu.45-B  276 STPWGYFDENRFHCHFSPRDWQRLINNNWGFRPKRLNLKLFNIQVKEVTQNDGTTIANNLTSTVQVFTD
hu.57-B  275 STPWGYFDENRFHCHFSPRDWQRLINNNWGFRPKRLNFKLFNIQVREVTQNDGTTIANNLTSTVQVFTD
hu.35-B  276 STPWGYFDENRFHCHFSPRDWQRLINNNWGFRPKRLNFKLFNIQVKEVTQNDGTTIANNLTSTVQVFTD
hu.58-B  276 STPWGYFDENRFHCHFSPRDWQRLINNNWGFRPKRLNFKLFNIQVKEVTQNDGTTIANNLTSTVQVFTD
hu.28-B  276 STPWGYFDENRFHCHFSPRDWQRLINNNWGFRPKRLNFKLFNIQVKEVTQNDGTTIANNLTSTVQVFTD
hu.51-B  276 STPWGYFDENRFHCHFSPRDWQRLINNNWGFRPKRLNFKLFNIQVKEVTQNDGTTIANNLTSTVQVFTD
hu.19-B  276 STPWGYFDENRFHCHFSPRDWQRLINNNWGFRPKRLNFKLFNIQVKEVTQNDGTTIANNLTSTVQVFTD
hu.49-B  276 STPWGYFDENRFHCHFSPRDWQRLINNNWGFRPKRLNFKLFNIQVKEVTQNDGTTIANNLTSTVQVFTD
hu.52-B  276 STPWGYFDENRFHCHFSPRDWQRLINNNWGFRPKRLNFKLFNIQVKEVTQNDGTTIANNLTSTVQVFTD
hu.13-B  276 STPWGYFDENRFHCHFSPRDWQRLINNNWGFRPKRLNFKLFNIQVKEVTQNDGTTIANNLTSTVQVFTD
AAV2-B   276 STPWGHFDENRFHCHFSPRDWQRLINNNWGFRPKRLSFKLFNIQVKEVTQNDGTTIANNLTSTVQVFTD
hu.20-B  276 STPWGHFDENRFHCHFSPRDWQRLINNNWGFRPKRLSFKLFNIQVKEVTQNDGTTIANNLTSTVQVFTD
```

```
hu.24-B   276  STPWGYFDFNRFHCHFSPRDWQRLINNNWGFRPKRLSFKLFNIQVKEVTQNDGTTTIANNLTSTVQVFTD
hu.64-B   276  STPWGYFDFNRFHCHFSPRDWQRLINNNWGSRPKRLNFKLFNIQVKEVTQNDGTTTIANNLTSTVQVFTD
hu.27-B   276  STPWGYFDFNRFHCHFSPRDWQRLINNNWGFRPKRLSFKLFNIQVKEVTQNDGTTTIANNLTSTVQVFTD
hu.21-B   276  STPWGYFDFNRFHCHFSPRDWQRLINNNWGFRPKRLSFKLFNIQVKEVTQNDGTTTIANNLTSTVQVFTD
hu.22-B   276  STPWGYFDFNRFHCHFSPRDWQRLINNNWGFRPKRLSFKLFNIQVKEVTQNDGTTTIANNLTSTVQVFTD
hu.23-B   276  STPWGYFDFNRFHCHFSPRDWQRLINNNWGFRPKRLSFKLFNIQVKEVTQNDGTTTIANNLTSTVQVFTD
hu.7-C    276  STPWGYFDFNRFHCHFSPRDWQRLINNNWGFRPKRLNFKLFNIQVKEVTQNDGTTTIANNLTSTVQVFTD
hu.61-C   276  STPWGYFDFNRFHCHFSPRDWQRLINNNWGFRPKRLNFKLFNIQVKEVTQNDGTTTIANNLTSTVQVFTD
hu.56-C   276  STPWGYFDFNRFHCHFSPRDWQRLINNNWGFRPKRLNFKLFNIQVKEVTQNDGTTTIANNLTSTVQVFTD
rh.56-C   276  STPWGYFDFNRFHCHFSPRDWQRLINNNWGFRPKRLNFKLFNIQVKEVTQNDGTTTIANNLTSTVQVFTD
hu.9-C    276  STPWGYFDFNRFHCHFSPRDWQRLINNNWGFRPKRLNFKLFNIQVKEVTQNDGTTTIANNLTSTVQVFTD
hu.54-C   276  STPWGYFDFNRFHCRFSPRDWQRLINNNWGFRPKRLNFKLFNIQVKEVTQNDGTTTIANNLTSTVQVFTD
hu.53-C   276  STPWGYFDFNRFHCHFSPRDWQRLINNNWGFRPKRLNFKLFNIQVKEVTQNDGTTTIANNLTSTVQVFTD
hu.60-C   276  STPWGYFDFNRFHCHFSPRDWQRLINNNWGFRPKRLNFKLFNIQVKEVTQNDGTTTIANNLTSTVQVFTD
hu.55-C   276  STPWGYFDFNRFHCHFSPRDWQRLINNNWGFRPKRLNFKLFNIQVKEVTQNDGTTTIANNLTSTVQVFTD
hu.2-C    276  STPWGYFDFNRFHCHFSPRDWQRLINNNWGFRPKRLNFKLFNIQVKEVTQNDGTTTIANNLTSTVQVFTD
hu.1-C    276  STPWGYFDFNRFHCHFSPRDWQRLINNNWGFRPKRLNFKLFNIQVKEVTQNDGTTTIANNLTSTVQVFTD
hu.18-C   276  STPWGYFDFNRFHCHFSPRDWQRLINNSWGFRPKRLNFKLFNIQVKEVTQNDGTTTIANNLTSTVQVFTD
hu.3-C    277  STPWGYFDFNRFHCHFSPRDWQRLINSNWGFRPKRLNFKLFNIQVKEVTQNDGTTTIANNLTSTVQVFTD
hu.25-C   276  STPWGYFDFNRFHCHFSPRDWQRLINNNWGFRPKRLNFKLFNIQVKEVTQNDGTTTIANNLTSTVQVFTD
hu.15-C   276  STPWGYFDFNRFHCHFSPRDRQRLINNNWGFRPKRLNFKLFNIQVKEVTQNDGTTTIANNLTSTVQVFTD
hu.16-C   276  STPWGYFDFNRFHCHFSPRDWQRLINNNWGFRPKRLNFKLFNIQVKEVTQNDGTTTIANNLTSTVQVFTD
hu.11-C   276  STPWGYFDFNRFHCHFSPRDWQRLINNNWGFRPKRLNFKLFNIQVKEVTQNDGTTTIANNLTSTVQVFTD
hu.10-C   276  STPWGYFDFNRFHCHFSPRDWQRLVNNNRGFRPKRLNFKLFNIQVKEVTQNDGTTTIANNLTSTVQVFTD
hu.4-C    276  STPWGYFDFNRFHCHFSPRDWQRLINNNWGFRPKRLNFKLFNIQVKEVTQNDGTTTIANNLTSTVQVFTD
rh.54-D   278  STPWGYFDFNRFHCHFSPRDWQRLINNNWGFRPKKLNFKLFNIQVKEVTTNDGVTTIANNLTSTVQVFSD
rh.48-D   278  STPWGYFDFNRFHCHFSPRDWQRLINSNWGFRPKKLNFKLFNIQVKEVTTNDGVTTIANNLTSTVQVFSD
rh.55-D   278  STPWGYFDFNRFHCHFSPRDWQRLINNNWGFRPKKLNFKLFNIQVKEVTTNDGVTTIANNLTSTVQVFSD
rh.62-D   278  STPWGYFDFNRFHCHFSPRDWQRLINNNWGFRPKKLNFKLFNIQVKEVTTGDGVTTIANNLTSTVQVFSD
AAV7-D    278  STPWGYFDFNRFHCHFSPRDWQRLINNNWGFRPKKLRFKLFNIQVKEVTTNDGVTTIANNLTSTIQVFSD
rh.52-E   279  STPWGYFDFNRFHCHFSPRDWQRLINNNWGFRPKRLSFKLFNIQVKEVTQNEGTKTIANSLTSTIQVFTD
```

FIG. 2M

```
rh.51-E  279 STPWGYFDFENRFHCHFSPRDWQRLINNNWGFRPKRLSFKLFNIQVKEVTQNEGTKTIANNLTSTIQVFTD
hu.39-E  279 STPWGYLDFENRFHCHFSPRDWQRLINNNWGFRPKRLSFKLFNIQVKEVTQNEGTKTIANNLASTIQVFTD
rh.53-E  279 STPWGYFDFENRFHCHFSPRDWQRLINNNWGFRPKRLSFKLFNIQVKEVTQNEGTKTIANNLTSTIQVFTD
rh.37-E  279 STPWGYFDFENRFHCHFSPRDWQRLINNNWGFRPKRLSFKLFNIQVKEVTQNEGTKTIANNLTSTIQVFTD
rh.43-E  278 STPWGYFDFENRFHCHFSPRDWQRLINNNWGFRPKRLSFKLFNIQVKEVTQNEGTKTIANNLTSTIQVFTD
hu.50-E  279 STPWGYFDFENRFHCHFSPRDWQRLINNNWGFRPKRLSFKLFNIQVKEVTQNEGTKTIANNLTSTIQVFTD
rh.49-E  279 STPWGYFDFENRFHCHFSPRDWQRLINNNWGFRPKRLSFKLFNIQVKEVTQNEGTKTIANNLTSTIQVFTD
rh.61-E  279 STPWGYFDFENRFHCHFSPRDWQRPINNNWGFRPKRLSFKLFNIQVKEVTQNEGTKTIANNLTSTIQVFTD
hu.41-E  279 STPWGYFDFENRFHCHFSPRDWQRLINNNWGFRPKRLSFKLFNIQVKEVTQNEGTKTVANNLTSTIQVFTD
rh.64-E  279 STPWGYFDFENRFHCHFSPRDWQRLINNNWGFRPKRLSFKLFNIQVKEVTQNEGTKTIANNLTSTIQVFTD
hu.42-E  279 STPWGYFDFENRFHCHFSPRDWQRLINNNWGFRPKRLSFKLFNIQVKEVTQNEGTKTIANNLTSTIQVFTD
rh.57-E  279 STPWGYFDFENRFHCHFSPRDWQRLINNNWGFRPKRLSFKLFNIQVKEVTQNEGTKTIANNLTSTIQVFTD
hu.40-E  279 STPWGYFDFENRFHCHFSPRDWQRLINNNWGFRPKRLSFKLFNIQVKEVTQNEGTKTIANNLTSTIQVFTD
AAV8-E   279 STPWGYFDFENRFHCHFSPRDWQRLINNNWGFRPKRLSFKLFNIQVKEVTQNEGTKTIANNLTSTIQVFTD
rh.58-E  279 STPWGYFDFENRFHCHFSPRDWQRLINNNWGFRPKRLSFKLFNIQVKEVTQNEGTKTIANNLTSTIQVFTD
rh.40-E  279 STPWGYFDFENRFHCHFSPRDWQRLINNNWGFRPKRLSFKLFNIQVKEVTQDEGTKTIANNLTSTIQVFTD
hu.67-E  279 STPWGYFDFENRFHCHFSPRDWQRLINNNWGFRPKRLSFKLFNIQVKEVTQNEGTKTIANNLTSTIQVFTD
hu.17-E  279 STPWGYFDFENRFHCHFSPRDWQRLINNNWGFRPKRLSFKLFNIQVKEVTQNEGTKTIANNLTSTIQVFTD
hu.6-E   279 STPWGYFDFENRFHCHFSPRDWQRLINNNWGFRPKRLSFKLFNIQVKEVTQNEGTETIANNLTSTIQVFTD
hu.66-E  279 STPWGYFDFENRFHCHFSPRDWQRLINNNWGFRPKRLSFKLFNIQVKEVTQNEGTKTIANNLTSTIQVFTD
rh.38-E  279 STPWGYFDFENRFHCHFSPRDWQRLINNNWGFRPKRLSFKLFPENIQVKEVTQNEGTKTIANNLTSTIQVFTD
hu.32-F  278 STPWGYFDFENRFHCHFSPRDWQRLINNNWGFRPKRLNFKLFNIQVKEVTDNNGVKTIANNLTSVQVFTD
AAV9/hu  278 STPWGYFDFENRFHCHFSPRDWQRLINNNWGFRPKRLNFKLFNIQVKEVTDNNGVKTIANNLTSTVQVFTD
hu.31-F  278 STPWGYFDFENRFHCHFSPRDWQRLINNNWGFRPKRLNFKLFNIQVKEVTDNNGVKTIANNLTSTVQVFTD 360        370        380        390        400        410     420

AAV5    337 DDYQLPYVVGNGTEGCLPAFPPQVFTLPQYGYATLNRD-NTENPTERSSFFCLEYFPSKMLRTGNNFEFT
AAV3-3_ 346 SEYQLPYVLGSAHQGCLPPFPADVFMVPQYGYLTLNNG---SQAVGRSSFYCLEYFPSQMLRTGNNFQFS
AAV4-4_ 337 SSYELPYVMDAGQEGSLPPFPNDVFMVPQYGYCGLVTGNTSQQTDRNAFYCLEYFPSQMLRTGNNFEIT
```

```
AAV1-A   347 SEYQLPYVLGSAHQGCLPPFPADVFMIPQYGYLTLNNG----SQAVGRSSFYCLEYFPSQMLRTGNNFTFS
hu.46-A  347 SEYQLPYVLGSAHQGRLPPFPADVFMIPQYGYLTLNNG----SQAVGRSSSYCLEYFPSQMLRTGNNFTFS
hu.48-A  347 SEYQLPYVLGSAHQGCLPPFPADVFMIPQYGYLTLNNG----SQAVGRSSFYCLEYFPSQMLRTGNNFTFS
hu.44-A  347 SEYQLPYVLGSAHQGCLPPFPADVFMIPQYGYLTLNNG----SQAVGRSSFYCLEYFPSQMLRTGNNFTFS
hu.43-A  348 SEYQLPYVLGSAHQGCLPPFPADVFMIPQYGYLTLNNG----SQAVGRSSFYCLEYFPSQMLRTGNNFTFS
AAV6-A   347 SEYQLPYVLGSAHQGCLPPFPADVFMIPQYGYLTLNNG----SQAVGRSSFYCLEYFPSQMLRTGNNFTFS
hu.34-B  346 SEYQLPYVLGSAHQGCLPPFPADVFMVPQYGYLTLNNE----SQAVGRSSFYCLEYFPSQMLRTGNNFTFS
hu.47-B  346 SEYQLPYVLGSAHQGCLPPFPADVFMVPQYGYLTLNNG----SQAVGRSSFYCLEYFPSQMLRTGNNFTFS
hu.29-B  346 SEYQLPYVLGSAHQGCLPPFPADVFMVPQYGYLTLNNG----SQAVGRSSFYCLGYFPSQMLRTGNNFTFS
hu.63-B  346 SEYQLPYVLGSAHQGCLPPFPADVFMVPQYGYLTLNNG----SQAVGRSSFYCLEYFPSQMLRTGNNFTFS
hu.56-B  346 SEYQLPYVLGSAHQGCLPPFPADVFMVPQYGYLTLNNG----SQAVGRSSFYCLEYFPSQMLRTGNNFTFS
hu.45-B  346 LEYQLPYVLGSAHQGCLPPFPADVFMVPQYGYLTLNNG----SQAVGRSSFYCLEYFPSQMLRTGNNFTFS
hu.57-B  345 SGYQLPYVLGSAHQGCLPPFPADVFMVPQYGYPTLNNG----SQAVGRSSFYCLEYFPSQMLRTGNNFTFS
hu.35-B  346 LEYQLPYVLGSAHQGCLPPFPADVFMVPQYGYLTLNNG----SQAVGRSSFYCLEYFPSQMLRTGNNFTFS
hu.58-B  346 SEYQLPYVLGSAHQGCLPPFPADVFMVPQYGYLTLNNG----SQAVGRSSFYCLEYFPSQMLRTGNNFTFS
hu.28-B  346 SEYQLPYVLGSAHQGCLPPFPADVFMVPQYGYLTLNNG----SQAVGRSSFYCLEYFPSQMLRTGNNFTFS
hu.51-B  346 SEYQLPYVLGSAHQGCLPPFPADVFMVPQYGYLTLNNG----SQAVGRSSFYCLEYFPSQMLRTGNNFTFS
hu.19-B  346 SEYQLPYVLGSAHQGCLPPFPADVFMVPQYGYLTLNNG----SQAVGRSSFYCLEYFPSQMLRTGNNFTFS
hu.49-B  346 SEYQLPYVPGSAHQGCLPPFPADVFMVPQYGYLTLNNG----SQAVGRSSFYCLEYFPSQMLRTGNNFTFS
hu.52-B  346 SEYQLPYVLGSAHQGCLPPFPADVFMVPQYGYLTLSNG----SQAVGRSSFYCLEYFPSQMLRTGNNFTFS
hu.13-B  346 SEYQLPYVLGSAHQGCLPPFPADVFMVPQYGYLTLNNG----SQAVGRSSFYCPEYFPSQMLRTGNNFTFS
AAV2-B   346 SEYQLPYVLGSAHQGCLPPFPADVFMVPQYGYLTLNNG----SQAVGRSSFYCLEYFPSQMLRTGNNFTFS
hu.20-B  346 SEYQLPYVLGSAHQGCLPPFPADVFMVPQYGYLTLNNG----SQAVGRSSFYCLEYFPSQMLRTGNNFTFS
hu.24-B  346 SEYQLPYVLGSAHQGCLPPFPADVFMVPQYGYLTLNNG----SQAVGRSSFYCLEYFPSQMLRTGNNFTFS
hu.64-B  346 SGYQLPYVLGSAHQGCLPPFPADVFMVPQYGYLTLNNG----SQAVGRSSFYCLEYFPSQMLRTGNNFTFS
hu.27-B  346 SEYQLPYVLGSAHQGCLPPFPADVFMVPQYGYLTLNNG----SQAVGRSSFYCLEYFPSQMLRTGNNFTFS
hu.21-B  346 SEYQLPYVLGSAHQGCLPPFPADVFMVPQYGYLTLNNG----SQAVGRSSFYCLEYFPSQMLRTGNNFTFS
hu.22-B  346 SEYQLPYVLGSAHQGCLPPFPADVFMVPQYGYLTLNNG----SQAVGRSSFYCLEYFPSQTLRTGNNFTFS
hu.23-B  346 SEYQLPYVLGSAHQGCLPPFPADVFMVPQYGYLTLNNG----SQAVGRSSFYCLEYFPSQMLRTGNNFTFS
hu.7-C   346 SEYQLPYVLGSAHQGCLPPFPADVFMVPQYGYLTLNNG----SQAVGRSSFYCLEYFPSQMLRTGNNFQFS
```

```
hu.61-C  346  SEYQLPYVLGSAHQGCLPPFPADVFMVPQYGYLTLNNG----SQAVGRSSFYCLEYFPSQMLRTGNNFQFS
rh.56-C  346  SEYQLPYVLGSAHQGCLPPFPADVFMVPQYGYLTLNNG----SQAVGRSSFYCLEYFPSQMLRTGNNFQFS
hu.9-C   346  SEYPLPYVLGSAHQGCLPPFPADVFMVPQYGYLTLNNG----SQAVGRSSFYCLEYFPSQMLRTGNNFTFS
hu.54-C  346  SEYQLPYVLGSAHQGCLPPFPADVFMVPQYGYLTLNNG----SQAVGRSSFYCLEYFPSQMLRTGNNFQFS
hu.53-C  346  SEYQLPYVLGSAHQGCLPPFPADVFMVPQYGYLTLNNG----SQAVGRSSFYCLEYFPSQMLRTGNNFQFS
hu.60-C  346  SEYQLPYVLGSAHQGCLPPFPADVFMVPQYGYLTLNNG----SQAVGRSSFYCLEYFPSQMLRTGNNFQFS
hu.55-C  346  SEYQLPYVLGSAHQGCLPPFPADVFMVPQYGYLTLNNG----SQAVGRSSFYCLECFPSQMLRTGNNFQFS
hu.2-C   346  SEYQLPYVLGSAHQGCLPPFPADVFMVPQYGYLTLNNG----SQAVGRSSFYCLEYFPSQMLRTGNNFQFS
hu.1-C   346  SEYQLPYVLGSAHQGCLPPFPADVFMVPQYGYLTLNNG----SQAVGRSSFYCLEYFPSQMLRTGNNFQFS
hu.18-C  346  SEYQLPYVLGSAHQGCLPPFPADVFMVPQYGYLTLNNG----SQAVGRSSFYCLEYFPSQMLRTGNNFQFS
hu.3-C   347  SGYPLPYVPGSAHQGCLPPFPADVFMVPQYGYLTLNNG----SQAVGRSSFYCLEYFPSQMLRTGNNFQFS
hu.25-C  346  SEYQLPYVLGLAHQGCLPPFPADVFMVPQYGYLTLNNG----SQAVGRSPFYCLEYFPSQMLRTGNNFQFS
hu.15-C  346  SEYQLPYVLGSAHQGCLPPFPADVFMVPQYGYLTLNNG----SQAVGRSSFYCLEYFPSQMLRTGNNFQFS
hu.16-C  346  SEYQLPYVLGSAHQGCLPPFPADVFMVPQYGYLTLNNG----SQAVGRSSFYCLEYFPSQMLRTGNNFTFS
hu.11-C  346  SEYQLPYVLGSAHQGCLPPFPADVFTVPQYGYLTLNNG----SQAVGRSSFYCLEYFPSQMLRTGNNLTFS
hu.10-C  346  SEYQLPYVLGSAHQGCLPPFPADVFMVPQYGYLTLNNG----SQAVGRSSFYCLEYFPSQMLRTGNNFQFS
hu.4-C   346  SEYQLPYVLGSAHQGCLPPFPADVFMVPQYGYLTLNNG----SQSVGRSSFYCLEYFPSQVLRTGNNFTFS
rh.54-D  348  SEYQLPYVLGSAHQGCLPPFPADVFMIPQYGYLTLNNG----SQSVGRSSFYCLEYFPSQMLRTGNNFTFS
rh.48-D  348  SEYQLPYVLGSAHQGCLPPFPADVFMIPQYGYLTLNNG----SQSVGRSSFYCLEYFPSQMLRTGNNFTFS
rh.55-D  348  SEYQLPYVLGSAHQGCLPPFPADVFMIPQYGYLTLNNG----SQSVGRSSFYCLEYFPSQMLRTGNNFTFS
rh.62-D  348  SEYQLPYVLGSAHQGCLPPFPADVFMIPQYGYLTLNND----SQSVGRSSFYCLEYFPSQMLRTGNNFEFS
AAV7-D   348  SEYQPPYVLGSAHQGCLPPFPADVFMIPQYGYLTLNNG----SQSVGRSSFYCLEYFPSQMLRTGNNFEFS
rh.52-E  349  SEYQLPYVLGSAHQGCLPPFPADVFMIPQYGYLTPNNG----SQAVGRSSFYCLEYFPSQMLRTGNNFSFS
rh.51-E  349  SEYQLPYVLGSAHQGCQPPFPADVFMIPQYGYLTLNNG----SQAVGRSSFYCLEYFPSQMLRTGNNFSFS
hu.39-E  349  SEYQLPYVLGSAHQGCLPPFPADVFMIPQYGYLTLNNG----SQAVGRSSFYCLEYFPSQMLRTGNNFSFS
rh.53-E  349  SEYQLPYVLGSAHQGCLPPFPADVFMIPQYGYLTLNNG----SQAVGRSSFYCLEYFPSQMLRTGNNFEFS
hu.37-E  349  SEYQLPYVLGSAHQGCLPPFPADVFMIPQYGYLTLNNG----SQAVGRSSFYCLEYFPSQMLRTGNNFEFS
rh.43-E  348  SEYQLPYVLGSAHQGCLPPFPADVFMIPQYGYLTLNNG----SQAVGRSSFYCLEYFPSQMLRTGNNFQFT
rh.50-E  349  SEYQLPYVLGSAHQGCLPPFPADVFMIPQYGYLTLNNG----SQAVGRSSFYCLEYFPSQMLRTGNNFSFS
rh.49-E  349  SEYQLPYVLGSAHQGCLPPFPADVFMIPQYGNLTLNNG----SQAVGRSSFYCLEYFPSQMLRTGNNFSFS
```

FIG. 2P

```
rh.61-E   349 SEYQLPYVLGSAHQGCLPPFPADVFMIPQYGYLTLNNG----SQAVGRSSFYCLEYFPSQMLRTGNNFSFS
hu.41-E   349 SEYQLPYVLGSAHQGCLPPFPADVFMIPQYGYLTLNNG----SQAVGRSSFYCLEYFPSQMLRTGNNFSFS
rh.64-E   349 SEYQLPYVLGSAHQGCLPPFPADVFMIPQYGYLTLNNG----SQAVGRSSFYCLEYFPSQMLRTGNNFEFS
hu.42-E   349 SEYQLPYVLGSAHQGCLPPFPADVFMIPQYGYLTLNNG----SQAVGRSSFYCLEYFPSQMLRTGNNFEFS
hu.57-E   349 SEYQLPYVLGSAHQGCLPPFPADVFMIPQYGYLTLNNG----SQAVGRSSFYCLEYFPSQMLRTGNNFSFS
hu.40-E   349 SEYQLPYVLGSAHQGCLPPFPADVFMIPQYGYLTLNNG----SQAVGRSSFYCLEYFPSQMLRTGNNFSFS
AAV8-E    349 SEYQLPYVLGSAHQGCLPPFPADVFMIPQYGYLTLNNG----SQAVGRSSFYCLEYFPSQMLRTGNNFQFT
rh.58-E   349 SEYQLPYVLGSAHQGCLPPFPADVFMIPQYGYLTLNNG----SQAVGRSSFYCLEYFPSQMLRTGNNFSFS
rh.40-E   349 SEYQLPYVLGSAHQGCLPPFPADVFMIPQYGYLTLNNG----SQAVGRSSFYCLEYFPSQMLRTGNNFEFS
hu.67-E   349 SEYQLPYVLGSAHQGCLPPFPADVFMIPQYGYLTLNNG----SQAVGRSSFYCLEYFPSQMLRTGNNFEFS
hu.17-E   349 SEYQLPYVLGSAHQGCPPPFPADVFMIPQYGYLTLNNG----SQAVGRSSFYCLEYFPSQMRRTGNNFEFS
hu.6-E    349 SEYQLPYVLGSAHQGCPPPFPADVFMIPQYGYLTLNNG----SQAVGRSSFYCLEYFPSQMRRTGNNFEFS
hu.66-E   349 SEYQLPYVLGSAHQGCLPPFPADVFMIPQYGYLTLNNG----SQAVGRSSFYCLEYFPSQMLRTGNNFEFS
rh.38-E   349 SEYQLPYVLGSAHQGCLPPFPADVFMIPQYGYLTLNNG----SQAVGRSSFYCLEYFPSQMLRTGNNFEFS
rh.32-F   348 SDYQLPYVLGSAHEGCLPPFPADVFMIPQYGYLTLNDG----SQAVGRSSFYCLEYFPSQMLRTGNNFQFS
AAV9/hu   348 SDYQLPYVLGSAHEGCLPPFPADVFMIPQYGYLTLNDG----SQAVGRSSFYCLEYFPSQMLRTGNNFQFS
hu.31-F   348 SDYQLPYVLGSAHEGCLPPFPADVFMIPQYGYLTLNDG----GQAVGRSSFYCLEYFPSQMLRTGNNFQFS

....|....|....|....|....|....|....|....|....|....|....|....|....|
                        430       440       450       460       470       480       490

AAV5      406 YNFEEVPFHSSFAPSQNLFKLANPLVDQLYRFVSTN------NTGGVQFNKNLAGRYANTYKNWFPGP
AAV3-3    413 YTFEDVPFHSSYAHSQSLDRLMNPLIDQYLYYLWGLQSTTFGTTLNAGTATTNFTKLRPTNFSNFKKKNWLPGP
AAV4-4    407 YSFEKVPFHSMYAHSQSLDRLMNPLIDQYLYYLNRTQGTTSGTTNQSRLLFSQAGPQSMSLQARNWLPGP
AAV1-A    414 YTFEEVPFHSSYAHSQSLDRLMNPLIDQYLYYLNRTQ-NQSGSAQNKDLLFSRGSPAGMSVQPKNWLPGP
hu.46-A   414 YTFEEVPLHSSCAHSQSLDRLMNPLIDQYLYYLNRTQ-NQSGSAQNRDLLFSRGSPAGMSVQPKNWLPGP
hu.48-A   414 YTFEEVPFHSSYAHSQSLDRLMNPLIDQYLYYLNRTQ-NQSGSAQNKDLLFSRGSPAGMSVQPKNWLPGP
hu.44-A   414 YTFEEVPFHSSYAHSQSLDRLMNPLIDQYLYYLNRTQ-NQSGSAQNKDLLFSRGSPAGMSVQPKNWLPGP
hu.43-A   415 YTFEEVPFHSSYAHSQSLDRLMNPLIDQYLYYLYPNRTQ-NQSGSAQNKDLLFSRGSPAGMSVQPKNWLPGP
hu.34-A   414 YTFEEVPFHSSYAHSQSLDRLMNPLIVQLYYLNRTQ-NQSGSAQNKDLLFSRGSPAGMSVQPKNWLPGP
AAV6-A    414 YTFEDVPFHSSYAHSQSLDRLMNPLIDQYLYYLNRTQ-NQSGSAQNKDLLFSRGSPAGMSVQPKNWLPGP
hu.34-B   413 YTFEDVPFHSSYAHSQSLGRLMNPLIDQYLYYLSRTN-TPSGTTTQSRLQFSQAGASDIRDQSRNWLPGP
```

FIG. 2Q

```
hu.47-B    413  YTFEDVPFHSSYAHSQSLDRLMNPLIDQYLYYLSTTN-TPSGTTTQSRLQFSQAGASDIRDQSRNWLPGP
hu.29-B    413  YTFEDVPFHSSYAHSQSLDRLMNPLIDQYLYYLSRTN-TPSGTTTQSRLQFSQAGASDIRDQSRNWLPGP
hu.63-B    413  YTFEDVPFHSSYAHSQSLDRLMNPLIDQYLYYLSRTN-TPSGTTTQSRLQFSQAGASDIRDQSRNWLPGP
hu.56-B    413  YTFEDVPFHSSYAHSQSLDRLMNPLIDQYLYYLSRTN-TPSGTTTQSRLQFSQAGASDIRDQSRNWLPGP
hu.45-B    413  YTFEDVPFHSSYAHSQSLDRLMNPLIDQYLYYLSTTN-TPSGTTTQSRLQFSQAGASDIRDQSRNWLPGP
hu.57-B    412  YTFEDVPFHSSYAHSQSLDRLMNPLIDQYLYYLSRTN-TPSGTTTQSRLQFSQAGASDIRDQSRNWLPGP
hu.35-B    413  YTFEDVPFHSSYAHSQSLGRLMNPLIDQYLYYLSRTN-TPSGTTTQSRLQFSQAGASDIRDQSRNWLPGP
hu.58-B    413  YTFEDVPFHSSYAHSQSLDRLMNPLIDQYLYYLSRTN-TPSGTTTQSRLQFSQAGASDIQDQSRNWLPGP
hu.28-B    413  YTFEDVPFHSSYAHSQSLDRLMNPLIDQYLYYLSTTN-TPSGTTTQSRLQFSQAGASDIRDQSRNWLPGP
hu.51-B    413  YTFEDVPFHSSYAHSQSLDRLMNPLIDQYLYYLSRTN-TPSGTTTMSRLQFSQAGASDIRDQSRNWLPGP
hu.19-B    413  YTFEDVPFHSSYAHSQSLDRLMNPLIDQYLYYLSRTN-TPSGTTTMSRLQFSQAGASDIRDQSRNWLPGP
hu.49-B    413  YTFEDVPFHSSYAHSQSLDRLMNPLIDQYLYYLSRTN-TPSGTTTQSRLQFSQAGASDIRDQSRNWLPGP
hu.52-B    413  YTFEDVPFHSSYAHSQSLDRLMNPLIDQYLYYLSTTN-TPSGTTTQSRLQFSQAGASDIRDQSRNWLPGP
hu.13-B    413  YTFEDVPFHSSYAHSQSLDRLMNPLIDQYLYYLSRTN-TPSGTTTQSRLQFSQAGASDIRDQSRNWLPGP
AAV2-B     413  YTFEDVPFHSSYAHSQSLDRLMNPLIDQYLYYLSRTN-TPSGTTTQSRLQFSQAGASDIRDQSRNWLPGP
hu.20-B    413  YTFEDVPFHSSYAHSQSLDRLMNPLIDQYLYYLSRTN-TPSGTTTMSRLQFSQAGASDIRDQSRNWLPGP
hu.24-B    413  YTFEDVPFHSSYAHSQSLDRLMNPLVDQYLYYLSRTN-TPSGTTTMSRLQFSQAGASDIRDQSRNWLPGP
hu.64-B    413  YTFEDVPFHSSYAHSQSLDRLMNPLIDQYLYYLSRTN-TPSGTTTQSRLQFSQAGASDVRDQSRNWLPGP
hu.27-B    413  YTFEDVPFHSSYAHSQSLDRLMNPLIDQYLYYLSRTN-TPSGTTTMSRLQFSQAGASDIRDQSRNWLPGP
hu.21-B    413  YTFEDVPFHSSYAHSQSLDRLMNPLIDQYLYYLSRTN-TPSGTTTMSRLQFSQAGASDIRDQSRNWLPGP
hu.22-B    413  YTFEDVPFHSSYAHSQSLDRLMNPLIDQYLYYLSRTN-TPSGTTTQSRLQFSQAGASDIRDQSRNWLPGP
hu.23-B    413  YTFEDVPFHSSYAHSQSLDRLMNPLIDQYLYYLSRTN-TPSGTTTMSRLQFSQAGASDIRDQSRNWLPGP
hu.7-C     413  YTFEDVPFHSSYAHSQSLDRLMNPLIDQYLYYLNKTQ-SNSGTLQQSRLLFSQAGPTSMSLQAKNWLPGP
hu.61-C    413  YTFEDVPFHSSYAHSQSLDRLMNPLIDQYLYYLNKTQ-TNSGTLQQSRLLFSQAGPTNMSLQAKNRLPGP
rh.56-C    413  YTFEDVPFHSSYAHSQSLDRLMNPLIDQYLYYLNKTQ-SNSGALQQSRLLFSQAGPTSMSLQAKNWLPGP
hu.9-C     413  YTFEDVPFHSSYAHSQSLDRLMNPLIDQYLYYLNRTQ-TASGT-QQSRLLFSQAGPTSMSLQAKNWLPGP
hu.54-C    413  YTFEDVPFHSSYAHSQGLDRLMNPLIDQYLYYLNRTQ-TASGT-QQSRLLFSQAGPTSMSLQAKNWLPGP
hu.53-C    413  YTFEDVPFHSSYAHSQSLDRLMNPLVDQYLYYLNRTQ-TASGT-QQSRLLFSQAGPTSMSLQAKNWLPGP
hu.60-C    413  YTFEDVPFHSSYAHSQSLDRLMNPLIDQYLYYLNKTQ-TNSGTLQQSRLLFSQAGPTNMSLQAKNWLPGP
hu.55-C    413  YTFEDVPFHSSYAHSQSLDRLMNPLIDQYLYYLNRTQ-TASGT-QQSRLLFSQAGPTSMSLQAKNWLPGP
```

FIG. 2R

```
hu.2-C    413 YTFEDVPFHSSYAHSQSLDRLMNPLIDQYLYYLNKTQ-TNSGTLQQSRLLFSQAGPTNMSLQAKNWLPGP
hu.1-C    413 YTFEDVPFHSSYAHSQSLDRLMNPLIDQYLYYLNKTQ-TNSGTLQQSRLLFSQAGPTNMSLQAKNWLPGP
hu.18-C   413 YTFEDVPFHSSYAHSQSLDRLLNPLIDQYLYYLNKTQ-SNSGTLQQSRLLFSQAGPTSMSLQAKNWLPGP
hu.3-C    414 YTFEDVPFHSSYAHCQSLDRLMNPLIDQYLYYLNKTQ-TNSGTLQQSRLLFSQAGPTSMSLQAKNWLPGP
hu.25-C   413 YTFEDVPFHSSYAHSQSLDRLMNPLIDQYLYYLNKTQ-TNSGTLQQSRLLFSQAGPTNMSLQAKNWLPGP
hu.15-C   413 YTFEDVPFHSSYAHSQSLDRLMNPLIDQYLYYLNKTQ-SNSGTLQQSRLLFSQAGPTSMSLQAKNWLPGP
hu.16-C   413 YTFEDVPFHSSYAHSQSLDRLMNPLIDQYLYYLNKTQ-SNSGTLQQSRLLFSQAGPTSMSLQAKNWLPGP
hu.11-C   413 YTFEDVPFHSSYAHSQSLDRLMNPLIDQYLYYLNRTQ-SNSGTLQQSRLLFSQAGPTSMSLQAKNWLPGP
hu.10-C   413 YTFEDVPFHSSYAHSQSLDRLMNPLIDQYLYYLNRTQ-SNSGTLQQSRLLFSQAGPTSMSLQAKNWLPGP
hu.4-C    413 YTFEDVPFHSSYAHSQSLDRLMNPLIDQYLYYLNKTQ-TNSGTLQQSRLLFSQAGPTNMSLQAKNWLPGP
rh.54-D   415 YTFEDVPFHSSYAHSQSLDRLMNPLIDQYLYYLARTQSNPGGTSGNRELQFYQGGPSTMAEQAKNWLPGP
rh.48-D   415 YTFEDVPFHSSYAHSQSLDRLMNPLIDQYLYYLARTQSNAGGTAGNRELQFYQGGPTTMAEQAKNWLPGP
rh.55-D   415 YTFEDVPFHSSYAHSQSLDRLMNPLIDQYLYYLARTQSNAGGTAGNRELQFYQGGPTTMAEQAKNWLPGP
rh.62-D   415 YTFEDVPFHSSYAHSQSLDRLMNPLIDQYLYYLARTQSNAGGTAGNRELQFYQGGPTTMAEQAKNWLPGP
AAV7-D    415 YSFEDVPFHSSYAHSQSLDRLMNPLIDQYLYYLARTQSNPGGTAGNRELQFYQGGPSTMAEQAKNWLPGP
rh.52-E   416 YTFEDVPFHSSYAHSQSLDRLMNPLIDQYLYYLYLSQQLLSSQAGPSNMSAQARNWLPGP
rh.51-E   416 YTFEDVPFHSSYAHSQSLDRLMNPLIDQYLYYLYLSRTQS-TGGTAGTQQLLFSQAGPSNMSAQARNWLPGP
rh.39-E   416 YTFEDVPFHSSYAHSQSLDRLMNPLIDQYLYYLYLSRTQS-TGGTAGTQQLLFSRAGPSNMSAQARNWLPGP
rh.53-E   416 YTFEDVPFHSSYAHSQSLDRLMNPLIDQYLYYLYLSRTQS-TGGTAGTQQLLFSQAGPSNMSAQARNWLPGP
rh.37-E   416 YPFEDVPFHSSYAHSQSLDRLMNPLIDQYLYYLYLSRTQS-TGGTAGTQQLLFSQAGPSNMSAQARNWLPGP
rh.43-E   415 YTFEDVPFHSSYAHSQSLDRLMNPLIDQYLYYLYLSRTQT-TGGTANTQTLGFSQGGPNTMANQAKNWLPGP
rh.50-E   416 YTFEDVPFHSSYAHSQSLDRLMNPLIDQYLYYLYLSRTQS-TGGTAGTQQLLFSQAGPSNMSAQARNWLPGP
rh.49-E   416 YTFEDVPFHSSYAHSQSLDRLMNPLIDQYLYYLYLSRTQS-TGGTAGTQQLLFSQAGPSNMSAQARNWLPGP
rh.61-E   416 YTFEDVPFHSSYAHSQSLDRLMNPLIDQYLYYLYLSRTQS-TGGTAGTQQLLFSQAGPSNMSAQARNWLPGP
rh.41-E   416 YTFEDVPFHSSYAHSQSLDRLMNPLIDQYLYYLYLSRTQS-TGGTAGTQQLLFSQAGPANMSAQAKNWLPGP
rh.64-E   416 YTFEDVPFHSSYAHSQSLDRLMNPLIDQYLYYLYLSRTQS-TGGTAGTQQLLFSQAGPANMSAQAKNWLPGP
rh.42-E   416 YTFEDVPFHSSYAHSQSLDRLMNPLIDQYLYYLYLSRTQS-TGGTAGTQQLLFSQAGPANMSAQARNWLPGP
rh.57-E   416 YTFEDVPFHSSYAHSQSLDRLMNPLIDQYLYYLYLSRTQS-TGGTAGTQQLLFSQAGPSNMSAQARNWLPGP
rh.40-E   416 YTFEDVPFHSSYAHSQSLDRLMNPLIDQYLYYLYLSRTQS-TGGTAGTQQLLFSQAGPANMSAQAKNWLPGP
AAV8-E    416 YTFEDVPFHSSYAHSQSLDRLMNPLIDQYLYYLYLSRTQT-TGGTANTQTLGFSQGGPNTMANQAKNWLPGP
```

FIG. 2S

```
rh.58-E   416 YTFEDVPFHSSYAHSQSLDRLMNPLIDQYLYYLSRTQS-TGGTAGTQQLLFSQAGPSNMSAQARNWLPGP
rh.40-E   416 YTFEDVPFHSSYAHSQSLDRLMNPLIDQYLYYLSRTQS-TGGTQGTQQLLFSQAGPANMSARAKNWLPGP
hu.67-E   416 YTFEDVPFHSSYAHSQSLDRLMNPLIDQYLYYLSRTQS-TGGTQGTQQLLFSQAGPANMSAQAKNWLPGP
hu.17-E   416 YQFEDVPFHSSYAHSQSLDRLMNPLIDQYLYYLSRTQS-TGGTAGTQQLLFSQAGPNNMSAQAKNWLPGP
hu.6-E    416 YQFEDVPFHSSYAHSQSLDRLMNPLIDQYLYYLSRTQS-TGGTAGTQQLLFSQAGPNNMSAQAKNWLPGP
hu.66-E   416 YTFEDVPFHSSCAHSQSSDRLMNPLIDQYLYYLSRTRS-TGGTQGTQQLLFSQAGPANMSAQAKNWLPGP
rh.38-E   416 YTFEDVPFHSSYAHSQSLDRLMNPLIDQYLHYLSRTQS-TGGTQGTQQLLFSQAGPANMSAQAKNWLPGP
rh.32-F   415 YEFENVPFHSSYAHSQSLDRLMNPLIDQYLYYLSKTINGSG---QNQQTLKFSVAGPSNMAVQGRNYIPGP
rh.39/hu  415 YEFENVPFHSSYAHSQSLDRLMNPLIDQYLYYLSKTINGSG---QNQQTLKFSVAGPSNMAVQGRNYIPGP
hu.31-F   415 YEFENVPFHSSYAHSQSLDRLMNPLIDQYLYYLSKTINGSG---QNQQTLKFSVAGPSNMAVQGRNYIPGP
                       500       510       520       530       540       550       560
               ....|....|....|....|....|....|....|....|....|....|....|....|....|....|
AAV5      469 MGRTQGWNLGSGVN------RASVSAFATTNRMELEGASYQVPPQPNGMTNNLQSNTYALENTMIFNSQP
AAV3-3    483 CYRQQRLSKTANDN------NNSNFPWTAASKYHLNGRDSLVNPGPAMASHKDDEEKFFPMHGNLIFGKEG
AAV4-4    477 SIKQQGFSKTANQNYKIPATGSDSLIKYETHSTLDGRWSALTPGPMATAGPADSKFS-NSQLIFAGPKQ
AAV1-A    483 CYRQQRVSKTKTDN------NNSNFTWTGASKYNLNGRESIINPGTAMASHKDDEDKFFPMSGVMIFGKES
hu.46-A   483 CYRQQRVSKTKTDN------NNSNFTWTGASKYNLNGRESIINPGTAMASHKDDEDKFFPMSGVMIFGKES
hu.48-A   483 CYRQQRVSKTKTDN------NNSNFTWTGASKYNLNGRESIINPGTAVASHKDDEDKFFPMSGVMIFGKES
hu.44-A   483 CYRQQRVSKTKTDN------NNSNFTWTGASKYNLNGRESIINPGTAMASHKDDEDKFFPMSGVMIFGKES
hu.43-A   484 CYRQQRVSKTKTDN------NNSNFTWTGASKYNLNGRESIINPGTAMASHKDDEDKFFPMSGVMIFGKES
AAV6-A    483 CYRQQRVSKTKTDN------NNSNFTWTGASKYNLNGRESIINPGTAMASHKDDKDKFFPMSGVMIFGKES
hu.34-B   482 CYRQQRVSKTSADN------NNSEYSWTGATKYHLNGRDSLVNPGPAMASHKDDEEKFFPQSGVLIFGKQG
hu.47-B   482 CYRQQRVSKTSADN------NNSEYSWTGATKYHLNGRDSLVNPGPAMASHKDNEEKFFPQSGVLIFGKQG
hu.29-B   482 CYRQQRVSKTSADN------NNSEYSWTGATKYHLNGRDSLVNPGPAMASHKDDEEKFFPQSGVLIFGKQG
hu.63-B   482 CYRQQRVSKTSADN------NNSEYSWTGATKYHLNGRDSLVNPGPAMASHKDDEEKFFPQSGVLIFGKQD
hu.56-B   482 CYRQQRVSKTSADN------NNSEYSWTGATKYHLNGRDSLVNPGPAMASHKDDEEKFFPQSGVLIFGKQG
hu.45-B   482 CYRQQRVSKTAADN------NNSEYSWTGATKYHLNGRDSLVNPGPAVASHKDDEEKFFPQSGVLIFGKQG
hu.57-B   481 CYRQQRVSKTAADN------NNGEYSWTGATKYHLNGRDSLVNPGPAMASHKDDEEKFFPQSGVLIFGKQG
hu.35-B   482 CYRQQRVSKTSADN------NNSEYSWTGATKYHLNGRDSLVNPGPAMASHKDDEEKFFPQSGVLIFGKQG
```

FIG. 2T

| | | |
|---|---|---|
| hu.58-B | 482 | CYRQQRVSKTSADN------NNSEYSWIGATKYHLNGRDSLVNPGPAMASHKDDEEKFFPQSGVLIFGKQG |
| hu.28-B | 482 | CYRQQRVSKTSADN------NNSEYSWTGATKYHLNGRDSLVNPGPAMASHKDDEEKFFPQSGVLIFGKQG |
| hu.51-B | 482 | CYRQQRVSKTSADN------NNSEYSWTGATKYHLNGRDSLVNPGPAMASHKDNEEKFFPQSGVLIFGKQD |
| hu.19-B | 482 | CYRQQRVSKTAADN------NNSDYSWTGATKYHLNGRDSLVNPGPAMASHKDDEEKYFPQSGVLIFGKQD |
| hu.49-B | 482 | CYRQQRVSKTAADN------NNSEYSWTGATKYHLNGRDSLVNPGPAMASHKDDEEKFFPQSGVLIFGKQG |
| hu.52-B | 482 | CYRQQRVSKTSADN------NNSEYSWTGATKYHLNGRDSLVNPGPAMASHKDNEEKFFPQSGVLIFGKQG |
| hu.13-B | 482 | CYRQQRVSKTSADN------NNSEYSWTGATKYHLNGRDSLVNPGPAMASHKDDEEKFFPQSGVLIFGKQG |
| AAV2-B | 482 | CYRQQRVSKTSADN------NNSEYSWTGATKYHLNGRDSLVNPGPAMASHKDDEEKFFPQSGVLIFGKQG |
| hu.20-B | 482 | CYRQQRVSKTAADN------NNSDYSWTGATKYHLNGRDSLVNPGPAMASHKDDEEKYFPQSGVLIFGKQD |
| hu.24-B | 482 | CYRQQRVSKTAADN------NNSDYSWTGATKYHLNGRDSLVNPGPAMASHKDDEEKYFPQSGVLIFGKQD |
| hu.64-B | 482 | CYRQQRVSKTSADN------NNSEYSWTGATKYHLNGRDSLVNPGPAMASHKDDEEKFFPQSGVLIFGKQD |
| hu.27-B | 482 | CYRQQRVSKTAADN------NNSDYSWTGATKYHLNGRDSLVNPGPAMASHKDDEEKYFPQSGVLVFGKQD |
| hu.21-B | 482 | CYRQQRVSKTAADN------NNSDYSWTGATKYHLNGRDSLVNPGPAMASHKDDEEKYFPQSGVLIFGKQD |
| hu.22-B | 482 | CYRQQRVSKTAADN------NNSDYSWTGATKYHLNGRDSLVNPGPAMASHKDDEEKYFPQSGVLIFGKQG |
| hu.23-B | 482 | CYRQQRVSKTAADN------NNSDYSWTGATKYHLNGRDSLVNPGPAMASHKDDEEKYFPQSGVLIFGKQG |
| hu.7-C | 482 | CYRQQRLSKQANDN------NNSNFPWTAATKYHLNGRDSLVNPGPAMASHKDDEEKFFPMHGTLIFGKQG |
| hu.61-C | 482 | CYRQQRLSKQANDN------NNSNFPWTAATKYHLNGRDSLVNPGPAMASHKDDEEKFFPMHGTLIFGKQG |
| rh.56-C | 482 | CYRQQRLSKQANDN------NNSNFPWTAATKYHLNGRDSLVNPGPAMASHKDDEEKFFPMHGTLIFGKQG |
| hu.9-C | 482 | CYRQQRLSKQANDN------NNSNFPWTGATKYHLNGRDSLVNPGPAMASHKDDEEKFFPMHGTLIFGKEG |
| hu.54-C | 481 | CYRQQRLSKQANDN------NNSNFPWTAATKYYLNGRDSLVNPGPAMASHKDDEEKFFPMHGTLIFGKEG |
| hu.53-C | 481 | CYRQQRLSKQANDN------NNSNFPWTGATKYHLNGRDSLVNPGPAMASHKDDEEKFFPMHGTLIFGKEG |
| hu.60-C | 482 | CYRQQRLSKQANDN------NNSNFPWTAATKYHLNGRDSLVNPGPAMASHKDDEEKFFPMHGTLIFGKQG |
| hu.55-C | 481 | CYRQQRLSKQANDN------NNSNFPWTAATKYHLNGRDSLVNPGPAMASHKDDEEKFFPMHGTLIFGKQG |
| hu.2-C | 482 | CYRQQRLSKQANGN------NNSNFPWTAATKYHLNGRDSLVNPGPAMASHKDDEEKFFPMHGTLIFGKQG |
| hu.1-C | 482 | CYRQQRLSKQANDN------NNSNFPWTAATKYHLNGRDSLVNPGPAMASHKDDEEKFFPMHGTLIFGKQG |
| hu.18-C | 482 | CYRQQRLSKQANDN------NNSNFPWTAATKYHLNGRDSLVNPGPAMASHKDDEEKFFPMHGTLIFGKQG |
| hu.3-C | 483 | CYRQQRLSKQANDN------NNCNFPWTAATKYHLNGRDSLVNPGPAMASHKDDEEKFFPMHGTLIFGKQG |
| hu.25-C | 482 | CYRQQRLSKQANDN------NNSNFPWTAATKYHLNGRDSLVNPGPAMASHKDDEEKFFPMHGTLIFGKQG |
| hu.15-C | 482 | CYRQQRLSKQANDN------NNSNFPWTAATKYHLNGRDSLVNPGPAMASHKDDEEKFFPMHGTLIFGKQG |
| hu.16-C | 482 | CYRQQRLSKQANDN------NNSNFPWTAATKYHLNGRDSLVNPGPAMASHKDDEEKFFPMHGTLIFGKQG |

FIG. 2U

```
hu.11-C    482  CYRQQRLSKQANDN------NNSNFPWTAATKYRLNGRDSLVNPGPAMASHKDDEEKFFPMHGTLIFGKQG
hu.10-C    482  CYRQQRLSKQANDN------NNSNFPWTAATKYRLNGRDSLVNPGPAMASHKDDEEKFFPMHGTLIFGKQG
hu.4-C     482  CYRQQRLSKQANDN------NNSNFPWTAATKYHLNGRDSLVNPGPAMASHKDDEEKFFPMHGTLIFGKTG
rh.54-D    485  CFRQQRVSKTLDQN------NNSNFAWTGATKYHLNGRNSLVNPGVAMATHKDDEDRFFPSSGVLIFGKTG
rh.48-D    485  CFRQQRVSKTLDQN------NNSNFAWTGATKYHLNGRNSLVNPGVAMATHKDDEERFFPSSGVLIFGKTG
rh.55-D    485  CFRQQRVSKTLDQN------NNSNFAWTGATKYHLNGRNSLVNPGVAMATHKDDEERFFPSSGVLIFGKTG
rh.62-D    485  CFRQQRVSKTLDQN------NNSNFAWTGATKYHLNGRNSLVNPGVAMATHKDDEERFFPSSGVLIFGKTG
AAV7-D     485  CFRQQRVSKTLDQN------NNSNFAWTGATKYHLNGRNSLVNPGVAMATHKDDEERFFPSSGVLIFGKTG
rh.52-E    485  CYRQQRVSTTLSQN------NNSNFAWTGATKYHLNGRDSLVNPGVAMATNKDDEDRFFPSSGILMFGKQG
rh.51-E    485  CYRQQRVSTTLSQN------NNSNFAWTGATKYHLNGRDSLVNPGVAMATHKDDEDRFFPSSGILMFGKQG
rh.39-E    485  CYRQQRVSTTLSQN------NNSNFAWTGATKYHLNGRDSLVNPGVAMATHKDDEDRFFPSSGILMFGKQG
rh.53-E    485  CYRQQRVSTTLSQN------NNSNFAWTGATKYHLNGRDSLVNPGVAMATHKDDEDRFFPSSGILMFGKQG
hu.37-E    485  CYRQQRVSTTLSQN------NNSNFAWTGATKYHLNGRDSLVNPGVAMATHKDDEERFFPSSGVLMFGKQG
rh.43-E    484  CYRQQRVSTTTGQN------NNSNFAWTAGTKYHLNGRNSLANPGIAMATHKDDEERFFPVTG-SCFWQQN
rh.50-E    485  CYRQQRVSTTLSQN------NNSNFAWTGATKYHLNGRNSLANPGIAMATHKDDEERFFPSSGILMFGKQG
rh.49-E    485  CYRQQRVSTTLSQN------NNSNFAWTGATKYHLNGRDSLVNPGVAMATHKDDEDRFFPSSGILMFGKQG
rh.61-E    485  CYRQQRVSTTLSQN------NNSNFAWTGATKYHLNGRDSLVNPGVAMATHKDDEDRFFPSSGILMFGKQG
hu.41-E    485  CYRQQRVSTTLSQN------NNSNFAWTGATKYHLNGRDSLVNPGVAMATHKDDEERFFPSSGVLMFGKQG
rh.64-E    485  CYRQQRVSTTLSQN------NNSNFAWTGATKYHLNGRDSLVNPGVAMATHKDDEERFFPSSGVLMFGKQG
rh.42-E    485  CYRQQRVSTTLSQS------NNSNFAWTGATKYHLNGRDSLVNPGVAMATHKDDEERFFPSSGVLMFGKQG
rh.57-E    485  CYRQQRVSTTLSQN------NNSNFAWTGATKYHLNGRDSLVNPGVAMATHKDDEERFFPSSGVLMFGKQG
rh.40-E    485  CYRQQRVSTTLSQN------NNSNFAWTGATKYHLNGRDSLVNPGVAMATHKDDEERFFPSSGVLMFGKQG
hu.67-E    485  CYRQQRVSTTLSQN------NNSNFAWTGATKYHLNGRDSLVNPGVAMATHKDDEERFFPSSGVLMFGKQG
hu.17-E    485  CYRQQRVSTTLSQN------NNSNFAWTGATKYHLNGRDSLVNPGVAMATHKDDEERFFPSSGVLMFGKQG
AAV8-E     485  CYRQQRVSTTTGQN------NNSNFAWTAGTKYHLNGRNSLANPGIAMATHKDDEERFFPSNGILIFGKQN
rh.58-E    485  CYRQQRVSTTLSQN------NNSNFAWTGATKYHLNGRDSLVNPGVAMATHKDDEERFFPSSGILMFGKQG
rh.40-E    485  CYRQQRVSTTLSQN------NNSNFAWTGATKYHLNGRDSLVNPGVAMATHKDDEERFFPSSGVLMFGKQG
hu.6-E     485  CYRQQRVSTTLSQN------NNSNFAWTGATKYHLNGRDSLVNPGVAMATHKDDEERFFPSSGVLMFGKQG
hu.66-E    485  CYRQQRVSTTLSQN------NNSNFAWTGATKYHLNGRDSLVNPGVAMATHKDDEERFFPSSGVLMFGKQG
rh.38-E    485  CYRQQRVSTTLSQN------NNSNFAWTGATKYHLNGRDSLVNPGVAMATHKDDEERFFPSSGVLMFGKQG
```

FIG. 2V

```
hu.32-F   483 SYRQQRVSTTVTQN-----NNSEFAWPGASSWALNGRNSLMNPGPAMASHKEGEDRFFPLSGSLIFGKQG
AAV9/hu   483 SYRQQRVSTTVTQN-----NNSEFAWPGASSWALNGRNSLMNPGPAMASHKEGEDRFFPLSGSLIFGKQG
hu.31-F   483 SYRQQRVSTTVTQN-----NNSEFAWPGASSWALNGRNSLMNPGPAMASHKEGEDRFFPLSGSLIFGKQG 570        580        590        600        610        620        630
              ....|....|....|....|....|....|....|....|....|....|....|....|....|....|
AAV5      534 ANPGTTATYLEGNMLITSESETQPVNRVAYNVGGQMATNNQSSTTAPATGTYNLQEIVPGSVWMERDVYL
AAV3-3    548 T--TASNAELD-NVMITDEEEIRTTNPVATEQYGTVANNLQSSNTAPTTGTVNHQGALPGMVWQDRDVYL
AAV4-4    546 N--GNTATVPG-TLIFTSEEELAATNATDTDMWGNLPGGDQSNSNLPTVDRLTALGAVPGMVWQNRDIYY
AAV1-A    548 A--GASNTALD-NVMITDEEEIKATNPVATERFGTVAVNFQSSSTDPATGDVHAMGALPGMVWGALPGMVWQDRDVYL
hu.46-A   548 A--GASNTALD-NVMITDEEEIKATNPVATERFGTVAVNFQSSSTDPATGDVHAMGALPGMVWQDRDVYL
hu.48-A   548 A--GASSTALD-NVMITDEEEIKATNPVATERFGTVAVNFQSSSTDPATGDVHAMGALPGMVWQDRDVYL
hu.44-A   548 A--GASNTALD-NVMITDEEEIKATNPVATERFGTVAVNFQSSSTDPATGDVHAMGALPGMVWQDRDVYL
hu.43-A   549 A--GASNTALD-NVMITDEEEIKATNPVATERFGTVAVNFQSSSTDPATGDVHVMGALPGMVWQDRDVYL
AAV6-A    548 A--GASNTALD-NVMITDEEEIKATNPVATERFGTVAVNLQSSSTDPATGDVHAMGALPGMVWQDRDVYL
hu.34-B   547 S--EKTNVDIE-KVMITDEEEIRTTNPVATEQYGTVAVNLQSSTNLQRGNRQAATADVNTQGVLPGMVWQDRDVYL
hu.47-B   547 S--EKTNVDIE-KVMITDEEEIRTTNPVATEQYGTVAVNLQSSTNLQRGNRQAATADVNTQGVLPGMVWQDRDVYL
hu.29-B   547 P--EKTNVDIE-KVMITDEEEIRTTNPVATEQYGSVSTNLQSGNTQAATSDVNTQGVLPGMVWQDRDVYL
hu.63-B   547 S--GKTNVDIE-KVMITDEEEIRTTNPVATEQYGSVSTNLQSGNTQAATSDVNTQGVLPGMVWQDRDVYL
hu.56-B   547 S--EKTNVDIE-KVMITDEEEIRTTNPVATEQYGSVSTNLQSGNTQAATSDVNTQGVLPGMVWQDRDVYL
hu.45-B   547 S--EKTNVDIE-KVMITDEEEIRTTNPVATEQYGSVSTNLQSGNTQAATSDVNTQGVLPGMVWQDRDVYL
hu.57-B   546 S--EKTNVDIE-KVMITDEEEIRTTNPVATEQYGSVSTNLQSGNTQAATADVNTQGVLPGMVWQDRDVYL
hu.35-B   547 S--EKTNVDIE-KVMITDEEEIRTTNPVATEQYGSVSTNLQSGNTRAATSDVNTQGVLPGMVWQDRDVYL
hu.58-B   547 S--EKTNVDIE-KVMITDEEEIRTTNPVATEQYGSVSTNLQSGNTQAATADVNTQGVLPGMVWQDRDVYL
hu.28-B   547 S--EKTNVDIE-KVMITDEEEIRTTNPVATEQYGSVSTNLQSGNTQASTADVNTQGVLPGMVWQDRDVYL
hu.51-B   547 S--EKTNVDIE-KVMITDEEEIRTTNPVATEQYGSVSTNLQSGNTQAATADVNTQGVLPGMVWQDRDVYL
hu.19-B   547 S--GKTNVDIE-KVMITDEEEIRTTNPVATEQYGSVSTNLQSGNTQAATSDVNTQGVLPGMVWQDRDVYL
hu.49-B   547 S--EKTNVDIE-KVMITDEEEIRTTNPVATEQYGSVSTNLQSGNTQAATADVNTQGVLPGMVWQDRDVYL
hu.52-B   547 S--EKTNVDIE-KVMITDEEEIRTTNPVATEQYGSVSTNLQGGNTQAATADVNTQGVLPGMVWGQPGMVWQDRDVHL
hu.13-B   547 S--EKTNVDIE-KVMITDEEEIRTTNPVATEQYGSVSTNLQGGNTQAATADVNTQGVLPGMVWQDRDVYL
```

FIG. 2W

```
AAV2-B   547  S---EKTNVDIE-KVMITDEEEIRTTNPVATEQYGSVSTNLQRGNRQAATADVNTQGVLPGMVWQDRDVYL
hu.20-B  547  S---GKTNVDIE-KVMITDEEEIRTTNPVATEQYGSVSTNLQSGNTQAATSDVNTQGVLPGMVWQDRDVYL
hu.24-B  547  S---GKTNVDIE-KVMITDEEEIRTTNPVATEQYGSVSTNLQSGNTQAATSDVNTQGVLPGMVWQDRDVYL
hu.64-B  547  S---GKTNVDIE-KVMITDEEEIRTTNPVATEQYGSVSTNLQSGNTQAATSDVNTQGVLPGMVWQDRDVYL
hu.27-B  547  S---GKTNVDIE-KVMITDEEEIRTTNPAATEQYGSVSTNLQSGNTQAATSDVNTQGVLPGMVWQDRDVYL
hu.21-B  547  S---GKTNVDIE-KVMITDEEEIRTTNPVATEQYGSVSTNLQSGNTQAATSDVNTQGVLPGMVWQDRDVYL
hu.22-B  547  S---GKTNVDIE-KVMITDEEEIRTTNPVATEQYGSVSTNLQSGNTQAATSDVNTQGVLPGMVWQDRDVYL
hu.23-B  547  S---GKTNVDIE-KVMITDEEEIRTTNPVATEQYGSVSTYLQSGNTQAATSDVNTQGVLPGMVWQDRDVYL
hu.7-C   547  T---NANDADLD-NVMITDEEEIRTTNPVATEQYGVSNNLQNSNTGPTTGTVNHQGALPGMVWQDRDVYL
hu.61-C  547  T---NANDADLE-NVMITDEEEIRTTNPVATEQYGTVSNNLQNSNTGPTTGTVNHRGALPGMVWQDRDVYL
hu.56-C  547  T---NANDADLD-NVMITDEEEIRTTNPVATEQYGVSNNLQNSNTGPTTGTVNHQGALPGMVWQDRDVYL
rh.56-C  547  T---NANDADLE-HVMITDEEEIRTTNPVATEQYGVSNNLQNSNTGPTTENVNHQGALPGMVWQDRDVYL
hu.9-C   547  T---NANDADLE-NVMITDEEEIRTTNPVATEQYGTVSNNLQNSNTAASTETVNHQGALPGMVWQDRDVYL
hu.54-C  546  T---NATNAELE-NVMITDEEEIRTTNPVATEQYGTVSNNLQNSNTAASTETVNHQGALPGMVWQDRDVYL
hu.53-C  546  T---NATNAELE-NVMITDEEEIRTTNPVATEQYGTVSNNLQNSNTAASTETVNHQGALPGMVWQDRDVYL
hu.60-C  547  T---NANDADLE-NVMITDEEEIRTTNPVATEQYGTVSNNLQNSNTAASTETVNHQGALPGMVWQDRDVYL
hu.55-C  546  T---NATNAELE-NVMITDEEEIRTTNPVATEQYGTVSNNLQNSNTAASTETVNHQGALPGMVWQDRDVYL
hu.2-C   547  T---NANDADLE-NVMITDEEEIRATNPVATEQYGTVSNNLQNSNTGPTTGTVNRQGALPGMVWQDRDVYL
hu.1-C   547  T---NANDADLE-NVMITDEEEIRATNPVATEQYGTVSNNLQNSNTGPTTGTVNHQGALPGMVWQDRDVYL
hu.18-C  547  T---NANDADLD-NVMITDEEEIRTTNPVATEQYGYVSNNLQNSNTGPTTGTVNHQGALPGMVWQDRDVYL
hu.3-C   548  T---NANDADLE-NVMITDEEEIRTTNPVATEQYGTVSNNLQNSNTGPTTGTVNHQGALPGMVWQDRDVYL
hu.25-C  547  T---NANDADLE-NVMITDEEEIRTTNPVATEQYGTVSNNLQNSNTGPTTGTVNHQGALPGMVWQDRDVYL
hu.15-C  547  T---NANDADLE-NVMITDEEEIRTTNPVATEQYGTVSNNLQNSNTGPTTGTVNHQGALPGMVWQDRDVYL
hu.16-C  547  T---NANDADLD-NVMITDEEEIRTTNPVATEQYGYVSNNLQNSNTGPTTGTVNHQGALPGMVWQDRDVYL
hu.11-C  547  T---NANDADLE-HVMITDEEEIRTTNPVATEQYGTVSNNLQDSNTGPTTENVNHQGALPGMVWQDRDVYL
hu.10-C  547  T---NANDADLE-NVMITDEEEIRTTNPVATEQYGNVSNNLQNSNTGPTTENVNHQGALPGMVWQDRDVYL
hu.4-C   547  T---NANDADLE-HVMITDEEEIRTTNPVATEQYGNVSNNLQNSNTGPTTENVNHQGALPGMVWQDRDVYL
hu.17-C  547  T---NANDADLE-NVMITDEEEIRATNPVATEQYGTVSSNLQNSNTGPTTGTVNHQGALPGMVWQNRDVYL
rh.54-D  550  A---TN-KTTLE-NVLMTNEEEIRPTNPVATEEYGIVSSNLQAANTAAQTQVVNNQGALPGMVWQNRDVYL
rh.48-D  550  A---AN-KTTLE-NVLMTNEEEIRPTNPVATEEYGTVSSNLQAANTAANTAAQTQVVNNQGALPGMVWQNRDVYL
rh.55-D  550  A---AN-KTTLE-NVLMTNEEEIRPTNPVATEEYGTVSSNLQAANTAAQTQVVNNQGALPGMVWQNRDVYL
rh.62-D  550  A---AN-KTTLE-NVLMTNEEEIRPTNPVATEEYGTVSSNLQAANTAAQTQVVNNQGALPGMVWQNRDVYL
```

FIG. 2X

```
AAV7-D    550 A--TN-KTTLE-NVLMTNEEEIRPTNPVATEEYGIVSSNLQAANTAAQTQVVNNQGALPGMVWQNRDVYL
rh.52-E   550 A--GKDNVDYS-NVMLTSEEEIKTTNPVATEQYGVVADNLQQQNTAPIVGAVNSQGALPGMVWQNRDVYL
rh.51-E   550 A--GKDNVDYS-NVMLTSEEEIKTTNPVATEQYGVVADNLQQQNTAPIVGAVNSQGALPGMVWQNRDVYL
hu.39-E   550 A--GKDNVDYS-NVMLTSEEEIKTTNPVATEQYGVVADNLQQQNTAPTVGAVNSQGALPGMVWQNRDVYL
hu.53-E   550 A--GKDNVDYS-NVMLTSEEEIKTTNPVATEQYGVVADNLQQQNTAPIVGAVNSQGALPGMVWQNRDVYL
hu.37-E   550 A--GRDNVDYS-NVMLTSEEEIKTTNPVATEQYGVVADNLQQQNTGPIVGNVNSQGALPGMVWQNRDVYL
hu.43-E   548 A--ARDNADYS-DVMLTSEEEIKTTNPVATEEYGIVADNLQQQNTAPQIGTVNSQGALPGMVWQNRDVYL
rh.50-E   550 A--GKDNVDYS-NVMLTSEEEIKTTNPVATEQYGVVADNLQQQNTAPIVGAVNSQGALPGMVWQNRDVYL
rh.49-E   550 A--GKDNMGYS-NVMLTSEEEIKTTNPVATEQYGVVADNLQQQNTAPIVGAVNSQGALPGMVWQNRDVYL
rh.61-E   550 A--GKDNVDYS-NVMLTSEEEIKTTNPVATEQYGVVADNLQQDTAPIVGAVNSQGALPGMVWQNRDVYL
rh.41-E   550 A--GKDNVDYS-SVMLTSEEEIKTTNPVATEQYGVVADNLQQQNTAPIVGNVNSQGALPGMVWQNRDVYL
rh.64-E   550 A--GKDNVDYS-NVMLTSEEEIKTTNPVATEQYGVVADNLQQQNTAPIVGAVNSQGALPGMVWQNRDVYL
hu.42-E   550 A--GRDNVDYS-SVMLTSEEEIKTTNPVATEQYGVVADNLQQTNTGPIVGNVNSQGALPGMVWQNRDVYL
hu.57-E   550 A--GKDNVDYS-NVMLTSEEEIKTTNPVATEEYGIVADNLQQQNTAPIVGAVNSQGALPGMVWQNRDVYL
hu.40-E   550 A--GRDNVDYS-SVMLTSEEEIKTTNPVATEQYGVVADNLQQTNTGPIVGNVNSQGALPGMVWQNRDVYL
AAV8-E    550 A--ARDNADYS-DVMLTSEEEIKTTNPVATEEYGIVADNLQQQNTAPIVGAVNSQGALPGMVWQNRDVYL
rh.58-E   550 A--GKDNVDYS-NVMLTSEEEIKTTNPVATEQYGVVADNLQQANTGPIVGNVNSQGALPGMVWQNRDVYL
rh.40-E   550 A--GRDNVDYS-SVMLTSEEEIKTTNPVATEQYGVVADNLQQQNAAPIVGAVNSQGALPGMVWQNRDVYL
rh.67-E   550 A--GRDNVDYS-SVMLTSEEEIKTTNPVATEQYGVVADNLQQTNTGPIVGNVNSQGALPGMVWQNRDVYL
hu.17-E   550 A--GKDNVDYS-NVMLTSEEEIKTTNPVATEQYGVVADNLQQQNAAPIVGAVNSQGALPGMVWQNRDVYL
hu.6-E    550 A--GKDNVDYS-NVMLTSEEEIKTTNPVATEQYGVVADNLQQQNTGPIVGNVNSQGALPGMVWQNRDVYL
hu.66-E   550 A--GKDNVDYS-SVMLTSEEEIKTTNPVATEQYGVVADNLQQQNTGPIVGNVNSQGALPGMVWQNRDVYL
rh.38-E   550 A--GKDNVDYS-SVMLTSEEEIKTTNPVATEQYGVVADNLQQTNTGPIVGNVNSQGALPGMVWQNRDVYL
hu.32-F   548 T--GRDNVDAD-KVMITNEEEIKTTNPVATESYGQVATNHQSAQAQAQTGWVQNQGILPGMVWQDRDVYL
AAV9/hu   548 T--GRDNVDAD-KVMITNEEEIKTTNPVATESYGQVATNHQSAQAQAQTGWVQNQGILPGMVWQDRDVYL
hu.31-F   548 T--GRDNVDAD-KVMITNEEEIKTTNPVATESYGQVATNHQSAQAQAQTGWVQNQGILPGMVWQDRDVYL 640       650       660       670       680       690       700
                ....|....|....|....|....|....|....|....|....|....|....|....|....|..

AAV5      604 QGPIWAKIPETGAHFHPSPAMGGFGLKHPPPMMLIKNTPVPGN-ITSFSDVPVSSFITQYSTGQVTVEME
```

FIG. 2Y

```
AAV3-3    615 QGPIWAKIPHTDGHFHPSPLMGGFGLKHPPPQIMIKNTPVPANPPTTFSPAKFASFITQYSTGQVSVEIE
AAV4-4    -   QGPIWAKIPHTDGHFHPSPLIGGFGLKHPPPQIFIKNTPVPANPATTFSSTPVNSFITQYSTGQVSVQID
AAV1-A    615 QGPIWAKIPHTDGHFHPSPLMGGFGLKNPPPQILIKNTPVPANPPAEFSATKFASFITQYSTGQVSVEIE
hu.46-A   615 QGPIWAKIPHTDGHFHPSPLMGGFGLKNPPPQILIKNTPVPANPPAEFSATKFASFITQYSAGQVSVEIE
hu.48-A   615 QGPIWAKIPHTDGHFHPSPLMGGFGLKNPPPQILIKNTPVPANPPAEFSATKFASFITQYSTGQVSVEIE
hu.44-A   615 QGPIWAKIPHTDGHFHPSPLMGGFGLKNPPPQILIKNTPVPANPPAEFSATKFASFITQYSTGQVSVEIE
hu.43-A   616 QGPIWAKIPHTDGHFHPSPLMGGFGLKNPPPQILIKNTPVPANPPAEFSATKFASFITQYSTGQVSVEIE
AAV6-A    615 QGPIWAKIPHTDGHFHPSPLMGGFGLKHPPPQILIKNTPVPANPSTTFSAAKFASFITQYSTGQVSVEIE
hu.34-B   614 QGPIWAKIPHTDGHFHPSPLMGGFGLKHPPPQILIKNTPVPANPSTTFSAAKFASFITQYSTGQVSVEIE
hu.47-B   614 QGPIWAKIPHTDGHFHPSPLMGGFGLKHPPPQILIKNTPVPANPSTTFSAAKFASFITQYSTGQVSVEIE
hu.29-B   614 QGPIWAKIPHTDGHFHPSPLMGGFGLKHPPPQILIKNTPVPANPSTTFSAAKFASFITQYSTGQVSVEIE
hu.63-B   614 QGPIWAKIPHTDGHFHPSPLMGGFGLKHPPPQILIKNTPVPANPSTTFSAAKFASFITQYSTGQVSVEIE
hu.56-B   614 QGPIWAKIPHTDGHFHPSPLMGGFGLKHPPPQILIKNTPVPANPSTTFSAAKFASFITQYSTGQVSVEIE
hu.45-B   614 QGPIWAKIPHTDGHFHPSPLMGGFGLKHPPPQILIKNTPVPANPSTTFSAAKFASFITQYSTGQVSVEIE
hu.57-B   613 QGPIWAKIPHTDGHFHPSPLMGGFGLKHPPPQILIKNTPVPANPSTTFSAAKFASFITQYSTGRVSVEIE
hu.35-B   614 QGPIWAKIPHTDGHFHPSPLMGGFGLKHPPPQILIKNTPVPANPSTTFSAAKFASFITQYSTGQVSVEIE
hu.58-B   614 QGPIWAKIPHTDGHFHPSPLMGGFGLKHPPPQILIKNTPVPANPSTTFSAAKFASFITQYSTGQVSVEIE
hu.28-B   614 QGPIWAKIPHTDGHFHPSPLMGGFGLKHPPPQILIKNTPVPANPSTTFSAAKFASFITQYSTGQVSVEIE
hu.51-B   614 QGPIWAKIPHTDGHFHPSPLMGGFGLKHPPPQILIKNTPVPANPSTTFSAAKFASFITQYSTGQVSVEIE
hu.19-B   614 QGPIWAKIPHTDGHFHPSPLVGGFGLKHPPPQILIKNTPVPANPSTTFSAAKFASFITQYSTGQVSVEIE
hu.49-B   614 QGPIWAKIPHTDGHFHPSPLMGGFGLKHPPPQILIKNTPVPANPSTTFSAAKFASFITQYSTGQVSVEIE
hu.52-B   614 QGPIWAKIPHTDGHFHPSPMGGFGPKHPPPQILIKNTPVPANPSTTFSAAKFASFITQYSTGQVSVEIE
hu.13-B   614 QGPIWAKIPHTDGHFHPSPLMGGFGLKHPPPQILIKNTPVPANPSTTFSAAKFASFITQYSTGQVSVEIE
AAV2-B    614 QGPIWAKIPHTDGHFHPSPLMGGFGLKHPPPQILIKNTPVPANPSTTFSAAKFASFITQYSTGQVSVEIE
hu.20-B   614 QGPIWAKIPHTDGHFHPSPLMGGFGLKHPPPQILIKNTPVPANPSTTFSAAKFASFITQYSTGQVSVEIE
hu.24-B   614 QGPIWAKIPHTDGHFHPSPLMGGFGLKHPPPQILIKNTPVPANPSTTFSAAKFASFITQYSTGQVSVEIE
hu.64-B   614 QGPIWAKIPHTDGHFHPSPLMGGFGLKHPPPQILIKNTPVPANPSTTFSAAKFASFITQYSTGQVSVEIE
hu.27-B   614 QGPIWAKIPHTDGHFHPSPLMGGFGLKHPPPQILIKNTPVPANPSTTFSAAKFVSFITQYSTGQVSVEIE
hu.21-B   614 QGPIWAKIPHTDGHFHPSPLMGGFGLKHPPPQILIKNTPVPANPSTTFSAAKFASFITQYSTGQVSVEIE
hu.22-B   614 QGPIWAKIPHTDGHFHPSPLMGGFGLKHPPPQILIKNTPVPANPSTTFSAAKFASFITQYSTGQVSVEIE
```

```
rh.50-E   617 QGPIWAKIPHTDGNFHPSPLMGGFGLKHPPPQILIKNTPVPADPPTAFNQAKLNSFITQYSTGQVSVEIE
rh.49-E   617 QGPIWAKIPHTDGNFHPSPLMGGFGLKHPPPQILIKNTPVPADPPTAFNQAKLNSFITQYGTGQVSVEIE
rh.61-E   617 QGPIWAKIPHTDGNFHPSPLMGGFGLKHPPPQVLIKNTPVPADPPTAFNQAKLNSFITQYSTGQVSVEIE
rh.41-E   617 QGPIWAKIPHTDGNFHPSPLMGGFGLKHPPPQILIKNTPVPADPPTAFNQAKLASFITQYSTGQVSVEIV
rh.64-E   617 QGPIWAKIPHTDGNFHPSPLMGGFGLKHPPPQILIKNTPVPADPPTTFSQAKLASFITQYSTGQVSVEIE
hu.41-E   617 QGPIWAKIPHTDGNFHPSPLMGGFGLKHPPPQILIKNTPVPADPPTAFNQAKLNSFITQYSTGQVSVEIE
hu.64-E   617 QGPIWAKIPHTDGNFHPSPLMGGFGLKHPPPQILIKNTPVPADPPTTFSQAKLASFITQYSTGQVSVEIE
hu.42-E   617 QGPIWAKIPHTDGNFHPSPLMGGFGLKHPPPQILIKNTPVPADPPTTFSQAKLASFITQYSTGQVSVEIE
hu.57-E   617 QGPIWAKIPHTDGNFHPSPLMGGFGLKHPPPQILIKNTPVPADPPTAFNQAKLNSFITQYSTGQVSAEIE
hu.40-E   617 QGPIWAKIPHTDGNFHPSPLMGGLGLKHPPPQILIKNTPVPADPPTTFSQAKLASFITQYSTGQVSVEIE
AAV8-E    617 QGPIWAKIPHTDGNFHPSPLMGGFGLKHPPPQILIKNTPVPADPPTTFNQSKLNSFITQYSTGQVSVEIE
rh.58-E   617 QGPIWAKIPHTDGNFHPSPLMGGFGLKHPPPQILIKSTPVPADPPTAFNQAKLNSFITQYSTGQVSVEIE
rh.40-E   617 QGPIWAKIPHTDGNFHPSPLMGGFGLKHPPPQILIKNTPVPADPPTTFSQAKLASFITQYSTGQVSVEIE
hu.67-E   617 QGPIWAKIPHTDGNFHPSPLMGGFGLKHPPPQILIKNTPVPADPPTTFSQAKLASFITQYSTGQVSVEIE
hu.17-E   617 QGPIWAKIPHTDGNFHPSPLMGGFGLKHPPPQILIKNTPVPADPPTTFSQAKLASFITQYSTGQVSVEIE
hu.6-E    617 QGPIWAKIPHTDGNFHPSPLMGGFGLKHPPPQILIKNTPVPADPPTTFSQAKLASFITQYSTGQVSVEIE
hu.66-E   617 QGPIWAKIPHTDGNFHPSPLMGGFGLKHPPPQILIKNTPVPADPPTTFSQAKLASFITQYSTGQVSVEIE
rh.38-E   617 QGPIWAKIPHTDGNFHPSPLMGGFGLKHPPPQILIKNTPVPADPPTAFNKDKLNSFITQYSTGQVSVEIE
hu.32-F   615 QGPIWAKIPHTDGNFHPSPLMGGFGMKHPPPQILIKNTPVPADPPTAFNKDKLNSFITQYSTGQVSVEIE
AAV9/hu   615 QGPIWAKIPHTDGNFHPSPLMGGFGMKHPPPQILIKNTPVPADPPTAFNKDKLNSFITQYSTGQVSVEIE
hu.31-F   615 QGPIWAKIPHTDGNFHPSPLMGGFGMKHPPPQILIKNTPVPADPPTAFNKDKLNSFITQYSTGQVSVEIE

....|....|....|....|....|....|....|....|....|
               710       720       730       740       750
AAV5      673 WELKKENSKRWNPEIQYTNNYNDPQFVDFAPDSTGEYRTTRPIGTRYLTRPL*
AAV3-3    685 WELQKENSKRWNPEIQYTSNYNKSVNVDFTVDTNGVYSEPRPIGTRYLTRNL*
AAV4-4    683 WELQKERSKRWNPEVQFTSNYGQQNSLLWAPDAAGKYTEPRAIGTRYLTHHL*
AAV1-A    685 WELQKENSKRWNPEVQYTSNYAKSANVDFTVDNNGLYTEPRPIGTRYLTRPL*
hu.46-A   685 WELQKENSKRWNPEVQYTSNYAKSANVDFTVDNNGLYTEPRPIGTRYLTRPL*
hu.48-A   685 WELQKENSKRWNPEVQYTSNYAKSANVDFTVDNNGLYTEPRPIGTRYLTRPL*
hu.44-A   685 WELQKENSKRWNPEVQYTSNYAKSANVDFTVDNNGLYTEPRPIGTRYLTRPL*
hu.43-A   686 WELQKENSKRWNPEVQYTSNYAKSASVDFTVDNNGLYTEPRPIGTRYLTRPL*
```

FIG. 2AB

| | | |
|---|---|---|
| AAV6-A | 685 | WELQKENSKRWNPEVQYTSNYAKSANVDFTVDNNGLYTEPRPIGTRYLTRPL* |
| hu.34-B | 684 | WELQKENSKRWNPEIQYTSNYNKSVNVDFTVDTNGVYSEPRPIGTRYLTRNL* |
| hu.47-B | 684 | WELQKENSKRWNPEIQYTSNYNKSVNVDFTVDTNGVYSEPRPIGTRYLTRNL* |
| hu.29-B | 684 | WELQKENSKRWNPEIQYTSNYNKSVNVDFTVDTNGVYSEPRPIGTRYLTRNL* |
| hu.63-B | 684 | WELQKENSKRWNPEIQYTSNYNKSVNVDFTVDTNGVYSEPRPIGTRYLTRNL* |
| hu.56-B | 684 | WELQKENSKRWNPEIQYTSNYNKSVNVDFTVDTNGVYSEPRPIGTRYLTRNL* |
| hu.45-B | 684 | WELQKENSKRWNPEIQYTSNYNKSVNVDFTVDTNGVYSEPRPIGTRYLTRNL* |
| hu.57-B | 683 | WELQKENSKRWNPEIQYTSNYNKSVNVDFTVDTNGVYSEPRPIGTRYLTRNL* |
| hu.35-B | 684 | WELQKENSKRWNPEIQYTSNYNKSVNVDFTVDTNGVYSEPRPIGTRYLTRNL* |
| hu.58-B | 684 | WELQKENSKRWNPEIQYTSNYNKSVNVDFTVDTNGVYSEPRPIGTRYLTRNL* |
| hu.28-B | 684 | WELQKENSKRWNPEIQYTSNYNKSVNVDFTVDTNGVYSEPRPIGTRYLTRNL* |
| hu.51-B | 684 | WELQKENSKRWNPEIQYTSNYNKSVNVDFTVDTNGVYSEPRPIGTRYLTRNL* |
| hu.19-B | 684 | WELQKENSKRWNPEIQYTSNYNKSVNVDFTVDTNGVYSEPRPIGTRYLTRNL* |
| hu.49-B | 684 | WELQKENSKRWNPEIQYTSNYNKSVNVDFTVDTNGVYSEPRPIGTRYLTRNL* |
| hu.52-B | 684 | WELQKENSKRWNPEIQYTSNYNKSVNVDFTVDTNGVYSEPRPIGTRYLTRNL* |
| hu.13-B | 684 | WELQKENSKRWNPEIQYTSNYNKSVNVDFTVDTNGVYSEPRPIGTRYLTRNL* |
| AAV2-B | 684 | WELQKENSKRWNPEIQYTSNYNKSVNVDFTVDTNGVYSEPRPIGARYLTRNL* |
| hu.20-B | 684 | WELQKENSKRWNPEIQYTSNYNKSVNVDFTVDTNGVYSEPRPIGTRYLTRNL* |
| hu.24-B | 684 | WELQKENSKRWNPEIQYTSNYNKSVNVDFTVDTNGVYSEPRPIGTRYLTRNL* |
| hu.64-B | 684 | WELQKENSKRWNPEIQYTSNYNKSVNVDFTVDTNGVYSEPRPIGTRYLTRNL* |
| hu.27-B | 684 | WELQKENSKRWNPEIQYTSNYNKSVNVDFTVDTNGVYSEPRPIGTRYLTRNL* |
| hu.21-B | 684 | WELQKENSKRWNPEIQYTSNYNKSVNVDFTVDTNGVYSEPRPIGTRYLTRNL* |
| hu.22-B | 684 | WELQKENSKRWNPEIQYTSNYNKSVNVDFTVDTNGVYSEPRPIGTRYLTRNL* |
| hu.23-B | 684 | WELQKENSKRWNPEIQYTSNYNKSVNVDFTVDTNGVYSEPRPIGTRYLTRNL* |
| hu.7-C | 684 | WELQKENSKRWNPEIQYTSNYNKSVNVDFTVDTNGVYSEPRPIGTRYLTRNL* |
| hu.61-C | 684 | WELQKENSKRWNPEIQYTSNYNKSVNVDFTVDTNGVYSEPRPIGTRYLTRNL* |
| rh.56-C | 684 | WELQKENSKRWNPEIQYTSNYNKSVNVDFTVDTNGVYSEPRPIGTRYLTRNL* |
| hu.9-C | 684 | WELQKENSKRWNPEIQYTSNYNKSVNVDFTVDTNGVYSEPCPIGTRYLTRNL* |
| hu.54-C | 683 | WELQKENSKRWNPEIQYTSNYNKSVNVDFTVDTNGVYSEPRPIGTRYLTRNL* |
| hu.53-C | 683 | WELQKENSKRWNPEIQYTSNYNKSVNVDFTVDTNGVYSEPRPIGTRYLTRNL* |

FIG. 2AC

| | | |
|---|---|---|
| hu.60-C | 684 | WELQKENSKRWNPEIQYTSNYNKSVNVDFTVDTNGVYSEPRPIGTRYLTRNL* |
| hu.55-C | 683 | WELQKENSKRWNPEIQYTSNYNKSVNVDFTVDTNGVYSEPRPIGTRYLTRNL* |
| hu.2-C | 684 | WELQKENSKRWNPEIQYTSNYNKSVNVDFTVDTNGVYSEPRPIGTRYLTRNL* |
| hu.1-C | 684 | WELQKENSKRWNPEIQYTSNYNKSVNVDFTVDTNGVYSEPRPIGTRYLTRNL* |
| hu.18-C | 684 | WELQKENSKRWNPEIQYTSNYNKSVNVDFTVDTNGVYSEPRPIGTRYLTRNL* |
| hu.3-C | 685 | WELQKENSKRWNPEIQYTSNYNKSVNVDFTVDTNGVYSEPRPIGTRYPTRNL* |
| hu.25-C | 684 | WELQKENSKRWNPEIQYTSNYNKSVNVDFTVDTNGVYSEPRPIGTRYLTRNL* |
| hu.15-C | 684 | WELQKEDSKRWNPEIQYTSNYNKPVNVDFTVDTNGVYSEPRPIGTRYLTRNL* |
| hu.16-C | 684 | WELQKENSKRWNPEIQYTSNYNKSVNVDFTVDTNGVYSEPRPIGTRYLTRNL* |
| hu.11-C | 684 | WELQKENSKRWNPEIQYTSNYNKSVNVDFTVDTNNGVYSEPRPIGTRYLTRNL* |
| hu.10-C | 684 | WELQKENSKRWNPEIQYTSNYNKSVNVDFTVDTNGVYSEPRPIGTRYLTRNL* |
| hu.4-C | 684 | WELRKENSKRWNPEIQYTSNYNKSVNVDFTVDTNGVYSEPRPIGTRYLTRNL* |
| rh.54-D | 686 | WELQKENSKRWNPEIQYTSNFDKQTGVDFAVDSQGVYSEPRPIGTRYLTRNL* |
| rh.48-D | 686 | WELQKENSKRWNPEIQYTSNFDKQTGVDFAVDSQGVYSEPRPIGTRYLTRNL* |
| rh.55-D | 686 | WELQKENSKRWNPEIQYTSNFDKQTGVDFAVDSQGVYSEPRPIGTRYLTRNL* |
| rh.62-D | 686 | WELQKENSKRWNPEIQYTSNFDKQTGVDFAVDSQGVYSEPRPIGTRYLTRNL* |
| AAV7-D | 686 | WELQKENSKRWNPEIQYTSNFEKQTGVDFAVDSQGVYSEPRPIGTRYLTRNL* |
| rh.52-E | 687 | WELQKENSKRWNPEIQYTSNYYKSTNVDFAVNTEGVYSEPRPIGTRYLTRNL* |
| rh.51-E | 687 | WEPQKENSKRWNPEIQYTSNYYKSTNVDFAVNTEGVYSEPRPIGTRYLTRNL* |
| rh.39-E | 687 | WELQKENSKRWNPEIQYTSNYYKSTNVDFAVNTEGVYSEPRPIGTRYLTRNL* |
| rh.53-E | 687 | WELQKENSKRWNPEIQYTSNYYKSTNADFAVNTEGVYSEPRPIGTRYLTRNL* |
| rh.37-E | 687 | WELQKENSKRWNPEIQYTSNYYKSTNVDFAVNTEGVYSEPRPIGTRYPTRNL* |
| rh.43-E | 685 | WELQKENSKRWNPEIQYTSNYYKSTSVDFAVNTEGVYSEPRPIGTRYLTRNL* |
| rh.50-E | 687 | WELQKENSKRWSPEIQYTSNYYKSTNVDFAVNTEGVYSEPRPIGTRYLTRNL* |
| rh.49-E | 687 | WELQKENSKRWNPEIQYTSNYYKSTNVDFAVNTEGVYSEPRPIGTRYLTRNL* |
| rh.61-E | 687 | WELQKENSKRRNPEIQYTSNYYKSTNVDFAVNTEGVYSEPRPIGTRYLTRNL* |
| hu.41-E | 687 | WELQKENSKRWNPEIQYTSNYYKSTNVDFAVNTEGVYSEPRPIGTRYLTRNL* |
| rh.64-E | 687 | WELQKENSKRWNPEIQYTSNYYKSTNVDFAVNTEGTYSEPRPIGTRYLTRNL* |
| hu.42-E | 687 | WELQKENSKRWNPEIQYTSNYYKSTNVDFAVNTEGTYSEPRPIGTRYLTRNL* |
| rh.57-E | 687 | WELQKENSKRWNPEIQYTSNYYKSTNVDFAVNTEGVYSEPRPIGTRYLTRNL* |

FIG. 2AD

| | | |
|---|---|---|
| hu.40-E | 687 | WELQKENSKRWNPEIQYTSNYYKSTNVDFAVNTEGTYSEPRPIGTRYLTRNL* |
| AAV8-E | 687 | WELQKENSKRWNPEIQYTSNYYKSTNVDFAVNTEGVYSEPRPIGTRYLTRNL* |
| rh.58-E | 687 | WELQKENSKCWNPEIQYTSNYYKSTSVDFAVNTEGVYSEPRPIGTRYLTRNL* |
| rh.40-E | 687 | WELQKENSKRWNPEIQYTSNYYKSTNVDFAVNTEGVYSEPRPIGTRYLTRNL* |
| hu.67-E | 687 | WELQKENSKRWNPEIQYTSNYYKSTNVDFAVNSEGTYSEPRPIGTRYLTRNL* |
| hu.17-E | 687 | WELQKENSKRWNPEIQYTSNYYKSTNVDFAVNTEGTYSEPRPIGTRYLTRNL* |
| hu.6-E | 687 | WELQKENSKRWNPEIQYTSNYNKSVNVDFTVDTNGVYSEPRPIGTRYLTRNL* |
| hu.66-E | 687 | WELQKENSKRWNPEIQYTSNYYKSTNVDFAVNTEGTYSEPRPIGTRYLTRNL* |
| rh.38-E | 687 | WELQKENSKRWNPEIQYTSNYYKSTNVDFAVNTEGTYSEPRPIGTRYLTRNL* |
| hu.32-F | 685 | WELQKENSKRWNPEIQYTSNYYKSNNVEFAVNTEGVYSEPRPIGTRYLTRNL* |
| AAV9/hu | 685 | WELQKENSKRWNPEIQYTSNYYKSNNVEFAVNTEGVYSEPRPIGTRYLTRNL* |
| hu.31-F | 685 | WELQKENSKRWNPEIQYTSNYYKSNNVEFAVSTEGVYSEPRPIGTRYLTRNL* |

| | | |
|---|---|---|
| rh.64-E | 71 | ACCTGAAACCTGGAGCCCCGAAACCCAAAGCCAACCAGCAAAAGCAGACGACGGCCGGGTCTGGTGCT |
| hu.42-E | 71 | ACCTGAAACCTGGAGCCCCAAGCCCAAAGCCAAGGCCAGCAGCAGAAGCAGACGACGGCCGGGTCTGGTGCT |
| rh.57-E | 71 | CGCTGAAACCTGGAGCCCCGAAGCCCAAAGCCGAAGCCAACCAGCAGCAGAAGCAGACGACGGCCGGGTCTGGTGCT |
| rh.40-E | 71 | ACCTGAAACCTGGAGCCCCGAAACCCAAGGCCAACCAGCAGCAGCAGAAGCAGACGACGGCCGGGTCTGGTGCT |
| AAV8-E | 71 | CGCTGAAACCTGGAGCCCCGAAGCCCAAAGCCAACCAGCAGCAGAAGCAGACGACGGCCGGGTCTGGTGCT |
| rh.58-E | 71 | ACCTGAAACCTGGAGCCCCAAGCCCAAAGCCAACCAGCAGCAGAAGCAGACGACGGCCGGGTCTGGTGCT |
| rh.40-E | 71 | ACCTGAAACCTGGAGCCCCAAGCCCAAGGCCAACCAGCAGCAGAAGCAGACGACGGCCGGGTCTGGTGCT |
| hu.67-E | 71 | ACCTGAAACCTGGAGCCCCGAAACCCAAGGCCAACCAGCAGCAGAAAGCAGACGACGGCCGGGTCTGGTGCT |
| hu.17-E | 71 | ACTTGAAACCTGGAGCCCCGAAACCCAAGGCCAACCAGCAGCAGAAGCAGACGACGGCCGGGTCTGGTGCT |
| hu.6-E | 71 | ACTTGAAACCTGGAGCCCCGAAACCCAAGGCCAACCAGCAGCAGAAGCAGACGACGGCCGGGTCTGGTGCT |
| hu.66-E | 71 | ACCTGAAACCTGGAGCCCCCCACCACCAAAGCCCGAGGCATAAGGACGACAGCGGCCGGGTCTGGTGCT |
| rh.38-E | 71 | ACCTGAAACCTGGCCGAGCCCCTCAACCAAGGCAATCAAGACAACGCTCGAGTCTTGTGCT |
| rh.32-F | 71 | AGCTCAAACCTGCCCGCCCCCACCACCAAAGCCCGAGGCATAAGGACGACAGCAGGGGTCTGTGCT |
| AAV9/hu | 71 | CTTTGAAACCTGGAGCCCCTCAACCAAGGCAATCAAGACAACGCTCGAGTCTTGTGCT |
| hu.31-F | 71 | AGCTCAAACCTGCCCGCCCCCAAAGCCCGAGGCATAAGGACGACAGCAGGGGTCTTGTGCT |

|    | | ....\|....\|....\|....\|....\|....\|....\|....\|....\|....\|....\|....\|  |
|    | | 150       160       170       180       190       200       210 |
| AAV5 | 138 | GCCTGGTTATAACTATCTCGGACCCGGAAACGGTCTCTCGATCGAGGAGCCTGTCAACAGGGCAGACGAG |
| AAV3-3 | 141 | TCCGGGTTACAAATACCTCGGACCCGGTAACGGACTCGACAAAGGAGAGCCGTCAACGAGGCGACGCG |
| AAV4-4 | 138 | TCCGGGTTACAAGTACCTCGGACCCGGTAACGGACTCGACAACGGAGAGCCGTCAACGAGGCGACGCG |
| AAV1-A | 141 | TCCTGGCTACAAGTACCTCGGACCCCTTCAACGGATCGACAACGGAGAGCCCGTCAACGCGGCGACGCA |
| hu.46-A | 141 | TCCTGGCTACAAGTACCTCGGACCCCTTCAACGGACTCGACAACGGAGAGCCCGTCAACGCGGCGACGCC |
| hu.48-A | 141 | TCCTGGCTACAAGTACCTCGGACCCCTTCAACGGACTCGACAACGGAGAGCCCGTCAACGCGGCGACGCC |
| hu.44-A | 141 | TCCTGGCTACAAGTACCTCGGACCCCTTCAACGGACTCGACAACGGAGAGCCGTCAACGCGGCGACGCC |
| hu.43-A | 141 | TCCTGGCTACAAGTACCTCGGACCCCTTCAACGGACTCGACAACGGAGAGCCCGTCAACGCGGCGACGCC |
| AAV6-A | 141 | TCCTGGGTACAAGTACCTCGGACCCCTTCAACGGACTCGACAACGGAGAGCCGTCAACGCGGCGATGCA |
| hu.34-B | 141 | TCCTGGGTACAAGTACCTCGGACCCCTTCAACGGACTCGACAACGGAGAGCCGTCAACGCGGCGACGCC |
| hu.47-B | 141 | TCCTGGGTACAAGTACCTCGGACCCCTTCAACGGACTCGACAACGGAGAGCCGTCAACGCGGCGACGCC |
| hu.29-B | 141 | TCCTGGGTACAAGTACCTCGGACCCCTTCAACGGACTCGACAACGGAGAGCCGTCAACGCGGCGACGCC |

| | | |
|---|---|---|
| hu.63-B | 141 | TCCTGGGTACAAGTACCTTCGGACCCCTTCAACGGACTCGACAAGGGAGAGAGCCGGTCAACGAGGCAGACGCC |
| hu.56-B | 141 | TCCTGGGTACAAGTACCTCGGACCCCTTCAACGGACTCGACAAGGGAGAGAGCCGGTCAACGAGGCAGACGCC |
| hu.45-B | 141 | TCCTGGGTACAAGTACCTCGGACCCCTTCAACGGACTCGACAAGGGAGAGAGCCGGTCAACGAGGCAGACGCC |
| hu.57-B | 138 | TCCTGGGATACAAGTACCTCGGACCCCTTCAACGGACTCGACAAGGGAGAGAGCCGGTCAACGAGGCAGACGCC |
| hu.35-B | 141 | TCCTGGGTACAAGTACCTCGGACCCCTTCAACGGACTCGACAAGGGAGAGAGCCGGTCAACGAGGCAGACGCC |
| hu.58-B | 141 | TCCTGGGTACAAGTACCTCGGACCCCTTCAACGGACTCGACAAGGGAGAGAGCCGGTCAACGAGGCAGACGCC |
| hu.28-B | 141 | TCCTGGGTACAAGTACCTCGGACCCCTTCAACGGACTCGACAAGGGAGAGAGCCGGTCAACGAGGCAGACGCC |
| hu.51-B | 141 | TCCTGGGTACAAGTACCTCGGACCCCTTCAACGGACTCGACAAGGGAGAGAGCCGGTCAACGAGGCAGACGCC |
| hu.19-B | 141 | TCCTGGGTACAAGTACCTCGGACCCCTTCAACGGACTCGACAAGGGAGAGAGCCGGTCAACGAGGCAGACGCC |
| hu.49-B | 141 | TCCTGGGTACAAGTACCTCGGACCCCTTCAACGGACTCGACAAGGGAGAGAGCCGGTCAACGAGGCAGACGCC |
| hu.52-B | 141 | TCCTGGGTACAAGTACCTCGGACCCCTTCAACGGACTCGACAAGGGAGAGAGCCGGTCAACGAGGCAGACGCC |
| hu.13-B | 141 | TCCTGGGTACAAGTACCTCGGACCCCTTCAACGGACTCGACAAGGGAGAGAGCCGGTCAACGAGGCAGACGCC |
| AAV2-B | 141 | TCCTGGGTACAAGTACCTCGGACCCCTTCAACGGACTCGACAAGGGAGAGAGCCGGTCAACGAGGCAGACGCC |
| hu.20-B | 141 | TCCTGGGTACAAGTACCTCGGACCCCTTCAACGGACTCGACAAGGGAGAGAGCCGGTCAACGAGGCAGACGCC |
| hu.24-B | 141 | TCCTGGGTACAAGTACCTCGGACCCCTTCAACGGACTCGACAAGGGAGAGAGCCGGTCAACGAGGCAGACGCC |
| hu.64-B | 141 | TCCTGGGTACAAGTACCTCGGACCCCTTCAACGGACTCGACAAGGGAGAGAGCCGGTCAACGAGGCAGACGCC |
| hu.27-B | 141 | TCCTGGGTACAAGTACCTCGGACCCCTTCAACGGACTCGACAAGGGAGAGAGCCGGTCAACGAGGCAGACGCC |
| hu.21-B | 141 | TCCTGGGTACAAGTACCTCGGACCCCTTCAACGGACTCGACAAGGGAGAGAGCCGGTCAACGAGGCAGACGCC |
| hu.22-B | 141 | TCCTGGGTACAAGTACCTCGGACCCCTTCAACGGACTCGACAAGGGAGAGAGCCGGTCAACGAGGCAGACGCC |
| hu.23-B | 141 | TCCTGGGTACAAGTACCTCGGACCCCTTCAACGGACTCGACAAGGGAGAGAGCCGGTCAACGAGGCAGACGCC |
| hu.7-C | 141 | TCCTGGGTACAAGTACCTCGGACCCCTTCAACGGACTCGACAAGGGAGAGAGCCGGTCAACGAGGCAGACGCC |
| hu.61-C | 141 | TCCTGGGTACAAGTACCTCGGACCCCTCAACGGACTCGACAAGGGGAGAGCCGGTCAACGAGGCAGACGCC |
| rh.56-C | 141 | TCCTGGGTACAAGTACCTCGGACCCCTTCAACGGACTCGACAAGGGGAGAGCCGGTCAACGAGGCAGACGCC |
| hu.9-C | 141 | TCCTGGGTACAAGTACCTCGGACCCCTTCAACGGACTCGACAAGGGGAGAGCCGGTCAACGAGGCAGACGCC |
| hu.54-C | 141 | TCCTGGGTACAAGTACCTCGGACCCCTTCAACGGACTCGACAAGGGGAGAGCCGGTCAACGAGGCAGACGCC |
| hu.53-C | 141 | TCCTGGGTACAAGTACCTCGGACCCCTTCAACGGACTCGACAAGGGGAGAGCCGGTCAACGAGGCAGACGCC |
| hu.60-C | 141 | TCCTGGGTACAAGTACCTCGGACCCCTTCAACGGACTCGACAAGGGGAGAGCCGGTCAACGAGGCAGACGCC |
| hu.55-C | 141 | TCCTGGGTACAAGTACCTCGGACCCCTTCAACGGACTCGACAAGGGGAGAGCCGGTCAACGAGGCAGACGCC |
| hu.2-C | 141 | TCCTGGGTACAAGTACCTCGGACCCCTTCAACGGACTCGACAAGGGGAGAGCCGGTCAACGAGGCAGACGCC |
| hu.1-C | 141 | TCCTGGGTACAAGTACCTCGGACCCCTTCAACGGACTCGACAAGGGGAGAGCCGGTCAACGAGGCAGACGCC |

| | | |
|---|---|---|
| hu.24-B | 281 | ACCACGCCGACGCGGAGTTTCAGGAGCGCCCTTAAAGAGGATACGTCTTTTGGGGCAACCTCGGACGAGC |
| hu.64-B | 281 | ACCACGCCGACGCGGAGTTTCCAGGAGCGTCTTAAAGAAGATACGTCTCTTTGGGGCAACCTCGGACGAGC |
| hu.27-B | 281 | ACCACGCCGACGCGGAGTTTCAGGAGCGTCTTAAAGAAGATACGTCTCTTTGGGGCAACCTCGGACGAGC |
| hu.21-B | 281 | ACCACGCCGACGCGGAGTTTCAGGAGCGCCCTTAAAGAGGATACGTCTTTTGGGGCAACCTCGGACGAGC |
| hu.22-B | 281 | ACCACGCCGACGCGGAGTTTCAGGAGCGCCCTTAAAGAGGATACGTCTTTTGGGGCAACCTCGGACGAGC |
| hu.23-B | 281 | ACCACGCCGACGCGGAGTTTCAGGAGCGTCTTAAAGAAGATACGTCTCTTTGGGGCAACCTCGGACGAGC |
| hu.7-C | 281 | ACCACGCCGACGCGGAGTTTCAGGAGCGTCTTAAAGAAGATACGTCTTTTGGGGCAACCTCGGACGAGC |
| hu.61-C | 281 | ACCACGCCGACGCGGAGTTTCAGGAGCGTCTTAAAGAAGATACGTCTTTTGGGGCAACCTCGGACGAGC |
| rh.56-C | 281 | ACCACGCCGACGCGGAGTTTCAGGAGCGTCTTAAAGAAGATACGTCTTTTGGGGCAACCTCGGACGAGC |
| hu.9-C | 281 | ACCACGCCGACGCGGAGTTTCAGGAGCGTCTTAAAGAAGATACGTCTTTTGGGGCAACCTCGGACGAGC |
| hu.54-C | 281 | ACCACGCCGACGCGGAGTTTCAGGAGCGTCTTAAAGAAGATACGTCTTTTGGGGCAACCTCGGACGAGC |
| hu.53-C | 281 | ACCACGCCGACGCGGAGTTTCAGGAGCGTCTTAAAGAAGATACGTCTTTTGGGGCAACCTCGGACGAGC |
| hu.60-C | 281 | ACCACGCCGACGCGGAGTTTCAGGAGCGTCTTAAAGAAGATACGTCTTTTGGGGCAACCTCGGACGAGC |
| hu.55-C | 281 | ACCACGCCGACGCGGAGTTTCAGGAGCGTCTTAAAGAAGATACGTCTTTTGGGGCAACCTCGGACGAGC |
| hu.2-C | 281 | ACCACGCCGACGCGGAGTTTCAGGAGCGTCTTAAAGAAGATACGTCTTTTGGGGCAACCTCGGACGAGC |
| hu.1-C | 281 | ACCACGCCGACGCGGAGTTTCAGGAGCGTCTTAAAGAAGATACGTCTTTTGGGGCAACCTCGGACGAGC |
| hu.18-C | 281 | ACCACGCCGACGCGGAGTTTCAGGAGCGTCTTAAAGAAGATACGTCTTTTGGGGCAACCTCGGACGAGC |
| hu.3-C | 281 | ACCACGCCGACGCGGAGTTTCAGGAGCGTCTTAAAGAAGATACGTCTTTTGGGGCAACCTCGGACGAGC |
| hu.25-C | 281 | ACCACGCCGACGCGGAGTTTCAGGAGCGTCTTAAAGAAGATACGTCTTTTGGGGCAACCTCGGACGAGC |
| hu.15-C | 281 | ACCACGCCGACGCGGAGTTTCAGGAGCGCCTTAAAGAAGATACGTCTTTTGGGGCAACCTCGGACGAGC |
| hu.16-C | 281 | ACCACGCCGGCGCGGAGTTTCAGGAGCGCCTTAAAGAAGATACGTCTTTTGGGGCAACCTCGGACGAGC |
| hu.11-C | 281 | ACCACGCCGACGCGGAGTTCCAGGAGCGTCTTAAAGAAGATACGTCTCTTTGGGGCAACCTCGGACGAGC |
| hu.10-C | 281 | ACCACGCCGACGCGGAGTTTCAGGAGCGTCTTAAAGAAGATACGTCTTTTGGGGCAACCTCGGACGAGC |
| hu.4-C | 281 | ACCACGCCGACGCGGAGTTTCAGGAGCGTCTCTGCAAGAAGATACGTCTTTTGGGGCAACCTCGGCCGAGC |
| rh.54-D | 281 | ACCACGCCGACGCGGAGTTTCAGGAGCGTCTCTGCAAGAAGATACGTCTTTTGGGGCAACCTCGGCCGAGC |
| rh.48-D | 281 | ATCACGCCGACGCGGAGTTTCAGGAGCGTCTCTGCAAGAAGATACGTCTTTTGGGGCAACCTCGGCCGAGC |
| rh.55-D | 281 | ACCACGCCGACGCCGAGTTCCAGGAGCGTCTCTGCAAGAAGATACGTCTTTTGGGGCAACCTCGGCCGAGC |
| rh.62-D | 281 | ACCACGCCGACGCGGAGTTTCAGGAGCGTCTCTGCAAGAAGATACGTCTCATTGGGGCAACCTCGGCCGAGC |
| AAV7-D | 281 | ACCACGCCGACGCGGAGTTTCAGGAGCGTCTCTGCAAGAAGATACGTCTTTTGGGGCAACCTCGGCCGAGC |
| rh.52-E | 281 | ATCACGCCGACGCCGAGTTCCAGGAGCGTCTCTGCAAGAAGATACGTCTTTTGGGGCAACCTCGGCCGAGC |

```
AAV1-A    351  AGTCTTCCAGGCCAAGAAGCGGGTTCTCGAACCTCTCGGT----CTGGTTGAGGAAGGCGCTAAGACGGCT
hu.46-A   351  AGTCTTCCAGGCCAAGAAGCGGGTTCTCGAACCTCTCGGT----CTGGTTGAGGAAGGCGCTAAGACGGCT
hu.48-A   351  AGTCTTCCAGGCCAAGAAGCGGGTTCTCGAACCTCTCGGT----CTGGTTGAGGAAGGCGCTAAGACGGCT
hu.44-A   351  AGTCTTCCAGGCCAAGAAGCGGGTTCTCGAACCTCTCGGT----CTGGTTGAGGAAGGCGCTGAGACGGCT
hu.43-A   351  AGTCTTCCAGGCCAAGAAGCGGGTTCTCGAACCTCTTTGT----CTGGTTGAGGAAGTGCTAAGACGGCT
AAV6-A    351  AGTCTTCCAGGCCAAGAGAGAGGGTACTTGAACCTCTGGGT----CTGGTTGAGGAACCTGTTAAGACGGCT
hu.34-B   351  AGTCTTCCAGGCGAAAAAGAGAGGGTTCTTGAACCTCTGGGC----CTGGTTGGGGAACCTGTTAAGACGGCT
hu.47-B   351  AGTCTTCCAGGCGAAAAAGAGAGGGTTCTGGAACCTCTGGGC----CTGGTTGAGGAGCCTGTTAAGACGGCT
hu.29-B   351  AGTCTTCCAGGCGAAAAAGAGAGGGTTCTTGAACCTCTGGGC----CTGGTTGAGGAACCTGTTAAGACGGCT
hu.63-B   351  AGTCTTCCAGGCGAAAAAGAGAGGGTTCTTGAACCTCTGGGC----CTGGTTGAGGAACCTGTTAAGACGGCT
hu.56-B   351  AGTCTTCCAGGCGAAAAAGAGAGGGTTCTTGAACCTCTGGGC----CTGGTTGAGGAACCTGTTAAGACGGCT
hu.45-B   351  AGTCTTCCAGGCGAAAAAGAGAGGGTTCTTGAACCTCTGGGC----CTGGTTGAGGAACCTGTCAAGACGGCT
hu.57-B   348  AGTCTTCCAGGCGAAAAAGAGAGGGTTCTTGAACCTCTGGGC----CTGGTTGAGGAACCTGTTAAGACGGCT
hu.35-B   351  AGTCTTCCAGGCGAAAAAGAGAGGGTTCTTGAACCTCTGGGC----CTGGTTGAGGAACCTGTTAAGACGGCT
hu.58-B   351  AGTCTTCCAGGCGAAAAAGAGAGGGTTCTTGAACCTCTGAGC----CTGGTTGAGGAGCCTGTTAAGACGGCT
hu.28-B   351  AGTCTTCCAGGCGAAAAAGAGAGGGATTCTTGAACCTCTGGGC----CTGGTTGAGGAGCCTGTTAAGACGGCT
hu.51-B   351  AGTCTTCCAGGCGAAAAAGAGAGGGATTCTTGAACCTCTGGGC----CTGGTTGAGGAGCCTGTTAAGACGGCT
hu.19-B   351  AGTCTTCCAGGCCAAAAAGAGAGGGATTCTTGAACCTCTGGGC----CTGGTTGGGGAACCTGTTAAGACGGCT
hu.49-B   351  AGTCTTCCAGGCGAAAAAGAGAGGGATTCTTGAACCTCTGGGC----CTGGTTGAGGAACCTGTTAAGACGGCT
hu.52-B   351  AGTCTTCCAGGCGAAAAAGAGAGGGATTCTTGAACCTCTGGGC----CTGGTTGGGGAACCTGTTAAACGGCT
hu.13-B   351  AGTCTTCCAGGCGAAAAAGAGAGGGATTCTTGAACCTCTGGGC----CTGGTTGAGGAGCCTGTTAAGGCGGCT
AAV2-B    351  AGTCTTCCAGGCCAAAAAGAGAGGGATTCTTGAACCTCTGGGC----CTGGTTGAGGAACCTGTTAAAACGGCT
hu.20-B   351  AGTCTTCCAGGCCAAAAAGAGAGGGATTCTTGAACCTCTGGGC----CTGGTTGAGGAACCTGTTAAGACGGCT
hu.24-B   351  AGTCTTCCAGGCCAAAAAGAGAGGGATTCTTGAACCTCTGGGC----CTGGTTGAGGAACCTGTTAAGACGGCT
hu.64-B   351  AGTCTTCCAGGCCAAAAAGAGAGGGATTCTTGAACCTCTGGGC----CTGGTTGAGGAACCTGTTAAGACGGCT
hu.27-B   351  AGTCTTCCAGGCCAAAAAGAGAGGGATTCTTGAACCTCTGGGC----CTGGTTGAGGAACCTGTTAAGACGGCT
hu.21-B   351  AGTCTTCCAGGCCAAAAAGAGAGGGTTCTTGAACCTCTGGGC----CTGGTTGAGGAACCTGTTAAGACGGCT
hu.22-B   351  AGTCTTCCAGGCCAAAAAGAGAGGGTTCTTGAACCTCTGGGC----CTGGTTGAGGAACCTGTTAAGACGGCT
hu.23-B   351  AGTCTTCCAGGCCAAAAAGAGAGGGTTCTTGAACCTCTGGGC----CTGGTTGAGGAACCTGTTAAGACGGCT
hu.7-C    351  AGTCTTCCAGGCGAAAAAGAGAGGGTTCTTGAACCTCTGGGC----CTGGTTGAGGACCTGTTAAGACGGCT
```

FIG. 30

```
hu.61-C   351  AGTCTTCCAGGCCAAAAAAGAGGGTTCTTGAACCTCTGGGC----CTGGTTGAGGAACCTGTTAAAACGGCT
rh.56-C   351  AGTCTTCCAGGCGAAAAAAGAGGGTTCTTGAACCTCTGGGC----CTGGTTGAGGAACCTGTTAAGACGGCT
hu.9-C    351  AGTCTTCCAGGCGAAAAAAGAGGGTTCTTGAACCTCTGGGC----CTGGTTGAGGAACCTGTTAAGACGGCT
hu.54-C   351  AGTCTTCCAGGCGAAAAAAGAGGGTTCTTGAACCTCTGGGC----CTGGTTGAGGAACCTGTTAAGACGGCT
hu.53-C   351  AGTCTTCCAGGCGAAAAAAGAGGGTTCTTGAACCTCTGGGC----CTGGTTGAGGAACCTGTTAAGACGGCT
hu.60-C   351  AGTCTTCCAGGCGAAAAAAGAGGGTTCTTGAACCTCTGGGC----CTGGTTGAGGAACCTGTTAAAACGGCT
hu.55-C   351  AGTCTTCCAGGCGAAAAAAGAGGGTTCTTGAACCTCTGGGC----CTGGTTGAGGAACCTGTTAAGACGGCT
hu.2-C    351  AGTCTTCCAGGCGAAAAAAGAGGGTTCTTGAACCTCTGGGC----CTGGTTGAGGAACCTGTTAAGACGGCT
hu.1-C    351  AGTCTTCCAGGCGAAAAAAGAGGGTTCTTGAACCTCTGGGC----CTGGTTGAGGAGCCTGTTAAGACGGCT
hu.18-C   351  AGTCTTCCAGGCGAAAAAAGAGGGTTCTTGAACCTCTGGGC----CTGGTTGAGGAGCCTGTTAAAACGGCT
hu.3-C    351  AGTCTTCCAGGCGAAAAAAGAGGGTTCTTGAACCTCTGGGC----CTGGTTGAGGAACCTGTTAAGACGGCT
hu.25-C   351  AGTCTTCCAGGCGAAAAAAGAGGGTTCTTGAACCTCTGCGCCCTGGTTGAGGAGCCTGTTAAAACGGCT
hu.15-C   351  AGTCTTCCAGGCCAAAAAAGAGGGTTCTTGAACCTCTGGGC----TTGGTTGGGGAGCCTGTTAAAACGGCT
hu.16-C   351  AGTCTTCCAGGCCAAAAAAGAGGGTTCTTGAACCTCTGGGC----TTGGTTGAGGAGCCTGTTAAGACGGCT
hu.11-C   351  AGTCTTCCAGGCGAAAAAAGAGGGTTCTTGAACCTCTGGGC----CTGGTTGAGGAACCTGTTAAGACGGCT
hu.10-C   351  AGTCTTCCAGGCGAAAAAAGAGGGTTCTTGAACCTCTGGGC----CTGGTTGAGGAACCTGTTAAGACGGCT
hu.4-C    351  AGTCTTCCAGGCGAAAAAAGAGGGTTCTTGAACCTCTGGGC----CTGGTTGAGGAGCCTGTTAAGACGGCT
rh.54-D   351  AGTCTTCCAGGCCAAGAAGAAGAGCGGGTTCTTGAACCTCTCGGT----CTGGTTGAGGAAGCTGCTAAGACGGCT
rh.48-D   351  AGTCTTCCAGGCCAAGAAGAAGAGCGGGTTCTTGAACCTCTCGGT----CTGGTTGAGGAAGCTGCTAAGACGGCT
rh.55-D   351  AGTCTTCCAGGCCAAGAAGAAGAGCGGGTCTTGAACCTCTCGGT----CTGGTTGAGGAAGCGCTAAGACGGCT
rh.62-D   351  AGTCTTCCAGGCCAAGAAGAAGAGCGGGTCTTGAACCTCTCGGT----CTGGTTGAGGAAGCGCTAAGACGGCT
AAV7-D    351  AGTCTTCCAGGCCAAGAAGAAGAGCGGGTCTTGAACCTCTCGGT----CTGGTTGAGGAAGCGCTAAGACGGCT
rh.52-E   351  AGTCTTCCAGGCCAAGAAGAAGAGCGGGTCTTGAACCTCTCGGT----CTGGTTGAGGAAGGCGCTAAGACGGCT
rh.51-E   351  AGTCTTCCAGGCCAAGAAGAAGAGCGGGTCTTGAACCTCTCGGT----CTGGTTGAGGAAGGCGCTAAGACGGCT
hu.39-E   351  AGTCTTCCAGGCCAAGAAGAAGAGCGGGTCTTGAACCTCTCGGT----CTGGTTGAGGAAGGCGCTAAGACGGCT
hu.53-E   351  AGTCTTCCAGGCCAAGAAGAAGAGCGGGTCTTGAACCTCTCGGT----CTGGTTGAGGAAGGCGCTAAGACGGCT
hu.37-E   351  AGTCTTCCAGGCCAAGAAGAAGAGCGGGTCTTGAACCTCTCGGT----CTGGTTGAGGAAGGCGCTAAGACGGCT
hu.43-E   351  AGTCTTCCAGGCCAAGAAGAAGAGCGGGTCTTCGAACCTCTCGGT----CTGGTTGAGGAAGGCGCTAAGACGGCT
rh.50-E   351  AGTCTTCCAGGCCAAGAAGAAGAGCGGGTCTTCGAACCTCTCGGT----CTGGTTGAGGAAGGCGCTAAGACGGCT
rh.49-E   351  AGTCTTCCAGGCCAAGAAGAAGAGCGGGTCTTCGAACCTCTCGGT----CTGGTTGAGGAAGGCGCTAAGACGGCT
```

FIG. 3P

```
                              430        440        450        460        470        480        490
                       ....|....|....|....|....|....|....|....|....|....|....|....|....|....|
rh.61-E   351  AGTCTTCCAGGCCAAGAAGCGGGTTCTCGAACCTCTCGGT---CTGGTTGAGGAAGGCGCTAAGACGGCT
hu.41-E   351  AGTCTTCCAGGCCAAGAAGCGGGTTCTCGAACCTCTCGGT---CCGGTTGAGGAAGCGCTAAGACGGCT
rh.64-E   351  AGTCTTCCAGGCCAAGAAGCGGGTTCTCGAACCTCTCGGT---CTGGTTGAGGAAGCGCTAAGACGGCT
hu.42-E   351  AGTCTTCCAGGCCAAGAAGCGGGTTCTCGAACCTCTCGGT---CTGGTTGAGGAAGCGCTAAGACGGCT
rh.57-E   351  AGTCTTCCAGGCCAAGAAGCGGGTTCTCGAACCTCTCGGT---CTGGTTGAGGAAGCGCTAAGACGGCT
hu.40-E   351  AGTCTTCCAGGCCAAGAAGCGGGTTCTCGAACCTCTCGGT---CTGGTTGAGGAAGCGCTAAGACGGCT
AAV8-E    351  AGTCTTCCAGGCCAAGAAGCGGGTTCTCGAACCTCTCGGT---CTGGTTGAGGAAGCGCTAAGACGGCT
rh.58-E   351  AGTCTTCCAGGCCAAGAAGCGGGTTCTCGAACCTCTCGGT---CTGGTTGAGGAAGCGCTAAGACGGCT
rh.40-E   351  AGTCTTCCAGGCCAAGAAGCGGGTTCTCGAACCTCTCGGT---CTGGTTGAGGAAGCGCTAAGACGGCT
hu.67-E   351  AGTCTTCCAGGCCAAGAAGCGGGTTCTCGAACCTCTCGGT---CTGGTTGAGGAAGCGCTAAGACGGCT
hu.17-E   351  AGTCTTCCAGGCCAAGAAGCGGGTTCTCGAACCTCTCGGT---CTGGTTGAGGAAGCGCTAAGACGGCT
hu.6-E    351  AGTCTTCCAGGCCAAGAAGCGGGTTCTCGAACCTCTCGGT---CTGGTTGAGGAAGCGCTAAGACGGCT
hu.66-E   351  AGTCTTCCAGGCCAAGAAGCGGGTTCTCGAACCTCTCGGT---CTGGTTGAGGAAGCGCTAAGACGGCT
rh.38-E   351  AGTCTTCCAGGCCAAAAAGAGAGGCTTCTCGAACCTCTTGT---CTGGTTGAGGAAGCGGCTAAGACGGCT
hu.32-F   351  AGTCTTCCAGGCCAAAAAGAGAGGCTTCTCTGAACCTCTTGT---CTGGTTGAGGAAGCGGCTAAGACGGCT
AAV9/hu   351  AGTCTTCCAGGCCAAAAAGAGAGGCTTCTTGAACCTCTTGGT---CTGGTTGAGGAAGCGGCTAAGACGGCT
hu.31-F   351  AGTCTTCCAGGCCAAAAAGAGAGGCTTCTTGAACCTCTTGGT---CTGGTTGAGGAAGCGGCTAAGACGGCT

AAV5      415  CCTACCGGAAAGCGGATAGAGCGACCACTTTCCA------------------------AAAA
AAV3-3    418  CCTGGAAAGAAGAAGGGGCTGTAGATCAGTCTCCTCAG---GAACCGGACTCATCATCTGGTTGGCAAAT
AAV4-4    415  CCTGGAAAGAAGAAGACCGTTGATTGAGCAGTCCCCCCAG---CAGCCCGACTCCTCCACGGTATCGCAAAA
AAV1-A    418  CCTGGAAAGAAGAACGTTCCGGTAGAGCAGTCGCCACAA---GAGCCAGACTCCTCCCCTCGGGCATCGGCAAGA
hu.46-A   418  CCTGGAAAGAAGAACGTTCCGGTAGAGCAGTCGCCACAA---GAGCCAGACTCCTCCCCTCGGGCATCGGCAAGA
hu.48-A   418  CCTGGAAAGAAGAACGTTCCGGTAGAGCAGTCGCCACAA---GAGCCAGACTCCTCCCCTCGGGCATCGGCAAGA
hu.44-A   418  CCTGGAAAGAAGAACGTTCCGGTAGAGCAGTCGCCACAA---GGGCCAGACTCCTCCCCTCGGGCATCGGCAAGA
hu.43-A   418  CCTGGAAAGAAGAACGTTCCGGTAGAGCAGTCGTCACCT---GAGCCAGACTCCTCCTCCACGGTCGGGCATCGGCAAGA
AAV6-A    418  CCTGGAAAGAAGAACGTTCCGGTAGAGCAGTCGCCACAA---GAGCCAGACTCCTCCTCCACGGTCGGGCATTGGCAAGA
hu.34-B   418  CCGGGAAAAAAAGAGGCCGGTAGAGCGCCGGTAGAGACTCCTCCTCCCTGGGAACCGGAAAGG
```

FIG. 3Q

```
hu.47-B   418  CCGGGAAAAAAGAGGCCGGTAGAGCACTCTCCTCCTGTG----GAGCCAGACTCCTCCTCGGGAACCGGAAAGG
hu.29-B   418  CCGGGAAAAAAGAGGCCGGTAGAGCACTCTCCTCCTGCA----GAGCCAGATTCCTCCTCGGGAACTGGAAAGT
hu.63-B   418  CCGGGAAAAAAGAGGCCGGTAGAGCACTCTCCTCCTGCG----GAGCCAGACTCCTCCTCGGGAACCGGAAAAG
hu.56-B   418  CCGGGAAAAAAGAGGCCGGTAGAGCACTCTCCTCCTGTG----GAGCCAGACTCCTCCTCGGGAACCGGAAAAG
hu.45-B   418  CCGGGAAAAAAGAGGCCGGTAGAGCACTCTCCTCCTGTG----GAGCCAGACTCCTCCTCGGGAACCGGAAAGG
hu.57-B   415  CCGGGAAAAAAGAGGCCCCGTAGAGCACTCTCCTCCTGTG----GAGCCAGACTCCTCCTCGGGAACCGGAAAGG
hu.35-B   418  CCGGGAAAAAAGAGGCCGGTAGAGCACTCTCCTCCTGTG----GAGCCAGACTCCTCCTCGGGAACCGGAAAGG
hu.58-B   418  CCGGGAAAAAAGAGGCCGGTAGAGCACTCTCCTCCTGTG----GAGCCAGACTCCTCCTCGGGAACCGGAAAAG
hu.28-B   418  CCGGGAAAAAAGAGGCCGGTAGAGCACTCTCCTCCCGCA----GAGCCAGATTCCTCCTCGGGAACTGGAAAGT
hu.51-B   418  CCAGGAAAAAAGAGGCCGGTAGAGCACTCTCCTCCTGTG----GAGCCAGACTCCTCCTCGGGAACCGGAAAAG
hu.19-B   418  CCGGGAAAAAAGAGGCCGGTAGAGCACTCTCCTCCTGCG----GAGCCAGACTCCTCCTCGGGAACCGGAAAAG
hu.49-B   418  CCGGGAAAAAAGAGGCCGGTAGAGCACTCTCCTCCTGTG----GAGCCAGACTCCTCCTCGGGAACAGGAAAAG
hu.52-B   418  CCGGGAAAAAAGAGGCCGGTAGAGCACTCTCCTCCTGTG----GAGCCAGACTCCTCCTCGGGAACCGGAAAGG
hu.13-B   418  CCGGGAAAAAAGAGGCCGGTAGAGCACTCTCCTCCTGCG----GAGCCAGACTCCTCCTCGGGAACCGGAAAAG
AAV2-B    418  CCGGGAAAAAAGAGGCCGGTAGAGCACTCTCCTCCTGTG----GAGCCAGACTCCTCCTCGGGAACCGGAAAAG
hu.20-B   418  CCGGGAGAAAAGAGGCCGGTAGAGCACTCTCCTCCTGCG----GAGCCAGACTCCTCCTCGGGAACCGGAAAAG
hu.24-B   418  CCGGGAAAAAAGAGGCCGGTAGAGCACTCTCCTCCTCCG----GAGCCAGACTCCTCCTCGGGAACCGGAAAAG
hu.64-B   418  CCGGGAAAAAAGAGGCCGGTAGAGCACTCTCCTCCTTCG----GAGCCAGACTCCTCCTCGGGAACCGGAAAAG
hu.27-B   418  CCGGGAAAAAAGAGGCCGGTAGAGCACTCTCCTCCTGCG----GAGCCAGACTCCTCCTCGGGAACCGGAAAAG
hu.21-B   418  CCGGGAAAAAAGAGGCCGGTAGAGCACTCTCCTCCTGCG----GAGCCAGACTCCTCCTCGGGAACCGGAAAAG
hu.22-B   418  CCGGGAAAAAAGAGGCCGGTAGAGCACTCTCCTCCTGTG----GAGCCAGACTCCTCCTCGGGAACCGGAAAAG
hu.23-B   418  CCGGGAAAAAAGAGGCCGGTAGAGCACTCTCCTCCTGCG----GAGCCAGACTCCTCCTCGGGAACCGGAAAAG
hu.7-C    418  CCGGGAAAAAAGAGGCCGGTAGAGCACCCCTCCTCCTGCG----GAGCCAGACTCCTCCTCGGGAACCGGAAAAG
hu.61-C   418  CCGGGAAAAAAGAGGCCGGTAGAGCACTCTCCTCCTGCG----GAGCCAGACTCCTCCTCGGGAACCGGAAAAG
rh.56-C   418  CCGGGAAAAAAGAGGCCGGTAGAGCACTCTCCTCCTGTG----GAGCCAGACTCCTCCTCGGGAACCGGAAAAG
hu.9-C    418  CCGGGAAAAAAGAGGCCGGTAGAGCACTCTCCTCCTGCG----GAGCCAGACTCCTCCTCGGGAACCGGAAAAG
hu.54-C   418  CCGGGAAAAAAGAGGCCGGTAGAGCACTCTCCTCCTGCG----GAGCCAGACTCCTCCTCGGGAACCGGAAAAG
hu.53-C   418  CCGGGAAAAAAGAGGCCGGTAGAGCACTCTCCTCCTGCG----GAGCCAGACTCCTCCTCGGGAACCGGAAAAG
hu.60-C   418  CCGGGAAAAAAGAGGCCGGTAGAGCACTCTCCTCCTGTG----GAGCCAGACTCCTCCTCGGGAACCGGAAAAG
hu.55-C   418  CCGGGAAAAAAGAGGCCGGTAGAGCACTCTCCTCCTGCG----GAGCCAGACTCCTCCTCGGGAACCGGAAAAG
```

| | | |
|---|---|---|
| rh.58-E | 418 | CCTGGAAAGAAGAGAGACCGTCACCTCAGCGTTCCCCGACTCCTCCACGGGCATCGGCAAGA |
| rh.40-E | 418 | CCTGGAAAGAAGAGAGACCGTCACCTCAGCGTTCCCCGACTCCTCCACGGGCATCGGCAAGA |
| hu.67-E | 418 | CCTGGAAAGAAGAGAGACCGTCACCTCAGCGTTCCCCGACTCCTCCACGGGCATCGGCAAGA |
| hu.17-E | 418 | CCTGGAAAGAAGAGAGACCGTCACCTCAGCCATTCACCCCAGACTCCTACGGGCATCGGCAAGA |
| hu.6-E | 418 | CCTGGAAAGAAGAGAGACCGTAGAACCGGTAGAGCCATTCACCCCAGACTCCTCCACGGGCATCGGCAAGA |
| hu.66-E | 418 | CCTGGAAAGAAGAGAGACCGGTAGAACCGGTAGAGCCATTCACCCCAGACTCCTCCACGGGCATCGGCAAGA |
| rh.38-E | 418 | CCTGGAAAGAAGAGAGACCGGTAGAACCGGTAGAACCGTCACCTCAGCGTTCTCCAGACTCCTCCGCGGGCATCGGCAAGA |
| rh.32-F | 418 | CCTGGAAAGAAGAGAGAGGCCTGTAGAGCAGTCAGCAGTCCTCCTCAG---GAACCGGACTCCTCCGCGGGTATTGGCAAAT |
| AAV9/hu | 418 | CCTGGAAAGAAGAGAGAGGCCTGTAGAGCAGTCAGCAGTCCTCCTCAG---GAACCGGACTCCTCCGCGGGTATTGGCAAAT |
| hu.31-F | 418 | CCTGGAAAGAAGAGAGAGGCCTGTAGAGCAGTCAGCAGTCCTCCTCAG---GAACCGGACTCCTCCGCGGGTATTGGCAAAT |

```
                500       510       520       530       540       550       560
         ....|....|....|....|....|....|....|....|....|....|....|....|....|
```

| | | |
|---|---|---|
| AAV5 | 452 | GAAAGAAGGCTCGGACCTGCCAAGAACTCCAAGCCTTCCACCTCGTCAGACGCCGAAGCTGGACCCAGCGG |
| AAV3-3 | 485 | CGGGCCAAACAGCCTGCCAGCCCGCCCGCCGCAGCCCGGCTAAAAAGAAGACTCCAGAGATGAAGACTAAATTCGGTCAGAGTCAGTCAGTCCCAGAC |
| AAV4-4 | 482 | AAGGCCAAGCAGCCGCCGGCCAGCCCGCCCGCCGGCTAAAAAGAAGAAGAAGACTCCAGAGATGAAGACTAAATTCGGTCAGACTGGAGAGTCAGTCAGTCAGACGGACAC-- |
| AAV1-A | 485 | CAGGCCAGCAGCCAGCAGCAGCCCGCCCGCCGGCTAAAAAGAAGACTCCAGAGATGAAGACTCAATTTTGGTCAGACTGGAGATCAGAGTCAGTCAGTCCGTCCCCGAT-- |
| hu.46-A | 485 | CAGGCCAGCAGCCAGCAGCAGCCCGCCCGCCGGCTAAAAAGAAGACTCCAGAGATGAAGACTCAATTTTGGTCAGACTGGAGACTCAGAGTCAGTCAGTCCGTCCCCGAT-- |
| hu.48-A | 485 | CAGGCCAGCAGCCAGCAGCAGCCCGCCCGCCGGCTAAAAAGAAGACTCCAGAGATGAAGACTCAATTTTGGTCCGCCAGACTGGAGACTCAGAGTCAGTCAGTCCGTCCCCGAT-- |
| hu.44-A | 485 | CAGGCCAGCAGCCAGCAGCAGCCCGCCCGCCGGCTAAAAAGAAGACTCCAGAGATGAAGACTCAATTTTGGTCCGCCAGACTGGAGACTCAGAGTCAGTCAGTCCGTCCCCGAT-- |
| hu.43-A | 488 | AAGGCCAGCAGCCAGCAGCAGCCCGCCCGCCGGCTAAAAAGAAGACTCCAGAGATGAACTCAATTTTGGTCAGACTGGAGACTCAGAGTCAGTCAGTCCGTCCCCGAC-- |
| AAV6-A | 485 | CAGGCCAGCAGCCAGCAGCAGCCCGCCCGCCGGCTAAAAAGAAGACTCCAGAGATGAACTCAATTTTGGTCAGACTGGAGACTCAGAGTCAGTCAGTCCGTCCCCGAC-- |
| hu.34-B | 485 | CGGGCCAGCAGCCAGCAGCAGCCTGCCAGCCCGCCCGCTGCAAGAAGAAGAGACTCCAGAGATGAATTCGGTCAGACTGGAGACAGACTCAGAGACTCAGTCAGTCCGTACCTGAC-- |
| hu.47-B | 485 | CGGGCCAGCAGCCAGCAGCAGCCTGCCAGCCCGCCCGCTGCAAGAAGAAGAGACTCCAGAGATGAATTCGGTCAGACTGGAGACAGACTCAGAGACTCAGTCAGTCCGTACCTGAC-- |
| hu.29-B | 485 | CGGGCCAACCAGCCAGCAGCAGCCTGCCAGCCCGCCCGCTGCAAGAAGAAGAGACTCCAGAGATGAATTCGGTCAGACTGGAGACAGACTCAGAGACTCAGTCAGTCCGTACCTGAC-- |
| hu.63-B | 485 | CGGGCCAACCAGCCAGCAGCAGCCTGCCAGCCCGCCCGCTGCAAGAAGAAGAGACTCCAGAGATGAATTCGGTCAGACTGGAGACAGACTCAGAGACTCAGTCAGTCCGTACCTGAC-- |
| hu.56-B | 485 | CGGGCCAACCAGCCAGCAGCAGCCTGCCAGCCCGCCCGCTGCAAGAAGAAAAGAGACTCCAGAGATGAATTCGGTCAGACTGGAGACAGACTCAGAGACTCAGTCAGTCCGTACCTGAC-- |
| hu.45-B | 485 | CGGGCCAACCAGCCAGCAGCAGCCTGCCAGCCCGCCCGCTGCAAGAAGAAAAGAGACTCCAGAGATGAATTCGGTCAGACTGGAGACAGACTCAGAGACTCAGTCAGTCCGTACCTGAC-- |
| hu.57-B | 482 | CGGGCCAACCAGCCAGCAGCAGCCTGCCAGCCCGCCCGCTGCAAGAAAAAGAGACTCCAGAGATGAATTCGGTCAGACTGGAGACAGACTCAGAGACTCAGTCAGTCCGTACCTGAC-- |
| hu.35-B | 485 | CGGGCCAACCAGCCAGCAGCAGCCTGCCAGCCCGCCCGCTGCAAGAAAAAGAGACTCCAGAGATGAATTCGGTCAGACTGGAGACAGACTCAGAGACTCAGTCAGTCCGTACCTGAC-- |

FIG. 3T

| | | |
|---|---|---|
| hu.58-B | 485 | CGGGCAACCAGCCTGCAAGAAAAGAGATTGAATTTCGGTCAGACTGGAGACGCAGACTCCGTACCTGAC--- |
| hu.28-B | 485 | CGGGCAACCAGCCTGCAAGAAAAGAGATTGAATTTCGGTCAGACTGGAGACGCAGACTCCGTACCTGAC--- |
| hu.51-B | 485 | CGGGCCAGCAGCCTGCAAGAAAAGAGATTGAATTTCGGTCAGACTGGAGACGCAGACTCAGTACCTGAC--- |
| hu.19-B | 485 | CGGGCCAGCAGCCTGCAGCAGAAAAGAGATTGAATTTTGGCCAGACTGGAGACGCAGACTCAGTACCTGAC--- |
| hu.49-B | 485 | CGGGCCAGCAGCCTGCAAGAAAAGAGATTGAATTTTGGTCAGACTGGAGACGCAGACTCCGTACCTGAC--- |
| hu.52-B | 485 | CGGGCCAGCAGCCTGCAAGAAAAGAGATTGAATTTTGGTCAGACTGGAGACGCAGACTCAGTACCTGAC--- |
| hu.13-B | 485 | CGGGCCAGCAGCCTGCAAGAAAAAGAGATTGAATTTTGGTCAGACTGGAGACGCAGACTCCGTACCTGAC--- |
| AAV2-B | 485 | CGGGCCAGCAGCCTGCAAGAAAAAGAGATTGAATTTTGGTCAGACTGGAGACGCAGACTCAGTACCTGAC--- |
| hu.20-B | 485 | CGGGCCAGCAGCCTGCAAGAAAAGAGATTGAATTTTGGTCAGACTGGAGACGCAGACTCAGTACCTGAC--- |
| hu.24-B | 485 | CGGGCCAGCAGCCTGCAAGAAGAAAGAGATTGAATTTTGGTCAGACTGGAGACGCAGACTCAGTACCTGAC--- |
| hu.64-B | 485 | CGGGCCAGCAGCCTGCAAGAAGAAAGAGATTGAATTTCGGTCAGACTGGAGACGCAGACTCCGTACCTGAC--- |
| hu.27-B | 485 | CGGGCCAGCAGCCTGCAAGAAAAGAGATTGAATTTTGGTCAGACTGGAGACGCAGACTCAGTACCTGAC--- |
| hu.21-B | 485 | CGGGCCAGCAGCCTGCAAGAAAAGAGATTGAATTTTGGTCAGACTGGAGACGCAGACTCAGTACCTGAC--- |
| hu.22-B | 485 | CGGGCCAGCAGCCTGCGAGAAAAGAGATTGAATTTTGGTCAGACTGGAGACGCAGACTCCGTACCTGAC--- |
| hu.23-B | 485 | CGGGCCAGCAGCCTGCAAGAAAAAGAGATTGAATTTTGGTCAGACTGGAGACGCAGACTCAGTACCTGAC--- |
| hu.7-C | 485 | CGGGCCAGCAGCCTGCAAGAAAAAGAGATTGAATTTTGGTCAGACTGGAGACGCAGACTCCGTACCTGAC--- |
| hu.61-C | 485 | CGGGCCAGCAGCCTGCAAGAAAAAGAGACTGAATTTCGGTCAGACTGGAGACGCAGACTCCGTACCTGAC--- |
| rh.56-C | 485 | CGGGCCAGCAGCCTGCAAGAAAAAGAGACTGAATTTCGGTCAGACTGGAGACGCAGACTCCGTACCTGAC--- |
| hu.9-C | 485 | CGGGCCATCAGCCTGCAAGAAAAAGAGAGATTGAATTTCGGTCAGACTGGAGACGCAGACTCCGTACCTGAC--- |
| hu.54-C | 485 | CGGGCCAGCAGCCTGCGAGAAAAAGAGATTGAATTTCGGTCAGACTGGAGACGCAGACTCCGTACCTGAC--- |
| hu.53-C | 485 | CGGGCCAGCAGCCTGCAAGAAAAAGAGATTGAATTTCGGTCAGACTGGAGACGCAGACTCCGTACCTGAC--- |
| hu.60-C | 485 | CGGGCCAGCAGCCTGCAAGAAAAAGAGATTGAATTTCGGTCAGACTGGAGACGCAGACTCCGTACCTGAC--- |
| hu.55-C | 485 | CGGGCCAGCAGCCTGCAAGAAAAAGAGATTGAATTTCGGTCAGACTGGAGACGCAGACTCCGTACCTGAC--- |
| hu.2-C | 485 | CGGGCCAGCAGCCTGCAAGAAAAAGAGATTAAATTTTGGTCAGACTGGAGACGCAGACTCCGTACCTGAC--- |
| hu.1-C | 485 | CGGGCCAGCAGCCTGCAAGAAAAAGAGATTAAATTTTGGTCAGACTGGAGACGCAGACTCCGTACCTGAC--- |
| hu.18-C | 485 | CGGGCCAGCAGCCTGCAAGAAAAAGAGATTGAATTTTGGTCAGACTGGAGACGCAGACTCCGTACCTGAC--- |
| hu.3-C | 488 | CGGGCCAGCAGCCTGCAAGAAAAAGAGATTAAATTTTGGTCAGACTGGAGACGCAGACTCCGTACCTGAC--- |
| hu.25-C | 485 | CGGGCAACCAGCCTGCAAGAAGAAAAGAGATTGAATTTGGTCAGACTGGAGACGCAGACTCCGTACCTGAC--- |
| hu.15-C | 485 | CGGGCAACCAGCCTGCAAGAAGAAAAGAGATTGAATTTGGTCAGACTGGAGACGCAGACTCCGTACCTGAC--- |
| hu.16-C | 485 | CGGGCAACCAGCCTGCAAGAAGAAAAGAGATTGAATTTGGTCAGACTGGAGACGCAGACTCCGTACCTGAC--- |

FIG. 3U

| | | |
|---|---|---|
| hu.11-C | 485 | CGGGCCATCAGCCTGCGAGAAAGAGATTGAATTTGGTCAGACTGGAGACGCAGACTCCGTACCTGAC-- |
| hu.10-C | 485 | CGGGCCATCAGCCTGCGAGAAAGAGATTGAATTTGGTCAGACTGGAGACGCAGACTCCGTACCTGAC-- |
| hu.4-C  | 485 | CGGGCCAGCAGCCTGCGAGAAAGAGATTAAATTTGGTCAGACTGGAGACGCAGACTCCGTACCTGAC-- |
| rh.54-D | 488 | AAGGCCAGCAGCCCGCTAGAAAGAGACTTGGGCAGACTTGGGCAGACTGGCGACTGGCGACTCCCCGAC-- |
| rh.48-D | 488 | AAGGCCAGCAGCCCGCTAGAAAGAGACTGAACTTGGGCAGACTTGGGCAGACTGGCGACTGGCGACTCCCCGAC-- |
| rh.55-D | 488 | AAGGCCAGCAGCCCGCCAGAAAGAGACTCAATTTCGGTCAGACTTGGGCAGACTGGCGACTGGCGACTCCCCGAC-- |
| rh.62-D | 488 | AAGGCCAGCAGCCCGCTAGAAAGAGACTGAACTTGGGCAGACTTGGGCAGACTGGCGACTGGCGACTCCCCGAC-- |
| AAV7-D  | 488 | AAGGCCAGCAGCCCGCCAGAAAGAGACTCAATTTCGGTCAGACTTCGGTCAGACTGGCGACTGGCGACTCCCCGAC-- |
| rh.52-E | 488 | AAGGCCAGCAGCCCGCCAGAAAGAGACTCAATTTCGGTCAGACTTCGGTCAGACTGGCGACTCAGAGTCAGTCCCCGAC-- |
| rh.51-E | 488 | AAGGCCAGCAGCCCGCCAGAAAGAGACTCAATTTCGGTCAGACTTCGGTCAGACTGGCGACTCAGAGTCAGTCCCCGAC-- |
| rh.39-E | 488 | AAGGCCAGCAGCCCGCCAGAAAGAGACTCAATTTCGGTCAGACTTCGGTCAGACTGGCGACTCAGAGTCAGTCCCCGAC-- |
| rh.53-E | 488 | AAGGCCAGCAGCCCGCCAGAAAGAGACTCAATTTCGGTCAGACTTCGGTCAGACTGGCGACTCAGAGTCAGTCCCCGAC-- |
| hu.37-E | 488 | AAGGCCAGCAGCCCGCCAGAAAGAGACTCAATTTCGGTCAGACTTTGGTCAGACTGGCGACTCAGAGTCAGTCCCCGAC-- |
| rh.43-E | 485 | AAGGCCAGCAACAGCCCGCCAGAAAGAGACTCAATTTGGCCAGACTTCGGTCAGACTGGCGACTCAGAGTCAGTCCAGAC-- |
| rh.50-E | 488 | AAGGCCAGCAGCCCGCCAGAAAGAGACTCAATTTCGGTCAGACTTCGGTCAGACTGGCGACTCAGAGTCAGTCCCCGAC-- |
| rh.49-E | 488 | AAGGCCAGCAGCCCGCCAGAAAGAGACTCAATTTCGGTCAGACTTCGGTCAGACTGGCGACTCAGAGTCAGTCCCCGAC-- |
| rh.61-E | 488 | AAGGCCAGCAGCCCGCCAGAAAGAGACTTTGGTCAGACTTTGGTCAGACTGGCGACTCAGAGTCAGTCCCCGAC-- |
| rh.41-E | 488 | AAGGCCAGCAGCCCGCTAAAAAGAGACTGAACTTTGGTCAGACTTGGTCAGACTGGCGACTCAGAGTCAGTCCCCGAC-- |
| rh.64-E | 488 | AAGGCCAGCAGCCCGCCAGAAAGAGACTTTGGTCAGACTTTGGTCAGACTGGCGACTCAGAGTCAGTCCCCGAC-- |
| hu.42-E | 488 | AAGGCCAGCAGCCCGCTAAAAAGAGACTGAACTTTGGTCAGACTTGGTCAGACTGGCGACTCAGAGTCAGTCCCCGAC-- |
| rh.57-E | 488 | AAGGCCAGCAGCCCGCCAGAAAGAGACTGAGCTTGGTCAGACTCAATTTGGTCAGACTGGCGACTCAGAGTCAGTTCCAGAC-- |
| rh.40-E | 488 | AAGGCCAACAGCCCGCCAGAAAGAGACTCAATTTGGTCAGACTTGGTCAGACTGGCGACTCAGAGTCAGTCCCCGAC-- |
| hu.67-E | 488 | AAGGCCAGCAGCCCGCCGAAAAGAGACTCAATTTGGTCAGACTTGGTCAGACTGGCGACTCAGAGTCAGTCCCCGAC-- |
| hu.17-E | 488 | AAGGCCAGCAGCCCGCTAAAAAGAGACTGAACTTTGGTCAGACTTTGGGCAGACTGGCGACTCAGAGTCAGTCCCCGAC-- |
| hu.6-E  | 488 | CAGGCCAGCAGCCCGCCAGAAAGAGACTCAACTTTGGTCAGACTTGGTCAGACTGGCGACTCAGAGTCAGTGCCCGAC-- |
| hu.66-E | 488 | CAGCCCAGCAGCCCGCCGAAAAGAGACTAAAAAGAGACTTTGGTCAGACTGGCGACTCAGAGTCAGTGCCCGAC-- |
| rh.38-E | 488 | AAGGCCAGCGGCCCGCCGCTAAAAAGAGACTGAACTTGGTCAGACTTGGTCAGACTGGCGACTCAGAGTCAGTCCCCGAC-- |

FIG. 3V

```
hu.32-F    485  CGGGTTCACAGCCCGCTAAAAGAAACTCAATTTCGGTCAGACTGGCGACACAGAGTCAGTCCCCGAC---
AAV9/hu    485  CGGGTGCACAGCCCGCTAAAAGAGACTCAATTTCGGTCAGACTGGCGACACAGAGTCAGTCCCAGAC---
hu.31-F    485  CGGGTTCACAGCCCGCTAAAAGAAACTCAATTTCGGTCAGACTGGCGACACAGAGTCAGTCCCCGAC---

570        580        590        600        610        620        630
                ....|....|....|....|....|....|....|....|....|....|....|....|....|....|
AAV5       522  ATCCCAGCAGCTGCAAATCCCAGCCCCAACCAGCCTCAAGTTGGGAGCTGATACAATGTCTGCGGGAGGT
AAV3-3     552  -CCTCAACCTCTCGGAGGATCAACTTCCGGAGCCATGTCT------CCACAAGTTTGGATCTAATACAATGGCTTCAGGCGCT
AAV4-4     546  ------CCTGAGGGATCAACTTCCGGAGCCATGTCT-----GATGACAGTGAGATGCGTGCAGCAGCT
AAV1-A     552  -CCACAACCTCTCGGAGAACCTCCAGCAACCCAGCAACAACCAGCCCCGCTGTGCTGGGACCTACTACAATGGCTTCAGGCGGT
hu.46-A    552  -CCACAACCTCTCGGAGAACCTCCAGCAACCCAGCAACAACCAGCCCCGCTGTGCTGGGACCTACTACAATGGCTTCAGGCGGT
hu.48-A    552  -CCACAACCTCTCGGAGAACCTCCAGCAACCCAGCAACAACCAGCCCCGCTGTGCTGGGACCTACTACAATGGCTTCAGGCGGT
hu.44-A    552  -CCACAACCTCTCGGAGAACCTCCAGCAACCCAGCAACAACCAGCCCCGCTGTGCTGGGACCTACTACAATGGCTTCAGGCGGT
hu.43-A    555  -CCTCAACCAATCGGAGAACCACCAGCAACCAGCAACCAGCCCCGCTGTCTGGTCTGGGATCTGGTACAATGGCTTCAGGCGGT
hu.6-A     552  -CCACAACCTCTCGGAGAACCTCCAGCAACCAGCAACCAGCCCCGCTGCTGGTCTGGGACCTACTACAATGGCTTCAGGCAGT
hu.34-B    552  -CCCCAGCCTCTCGGACACAGCAGCAGCAGCAGCAGCAGCCCCGCTCTCGGTCTGGGAACTAATAACGATGGCTACAGGCAGT
hu.47-B    552  -CCCCAGCCTCTCGGACACAGCAGCAGCAGCAGCAGCAGCCCCGCTCTCGGTCTGGGAACTAATAACGATGGCTACAGGCAGT
hu.29-B    549  -CCCCAGCCTCTCGGACACAGCAGCAGCAGCAGCAGCAGCCCCGCTCTCGGTCTGGGAACTAATAACGATGGCTACAGGCAGT
hu.63-B    552  -CCCCAGCCTCTCGGACACAGCAGCAGCAGCAGCAGCAGCCCCGCTCTCGGTCTGGGAACTAATAACGATGGCTACAGGCAGT
hu.56-B    552  -CCCCAGCCTCTCGGACACAGCAGCAGCAGCAGCATCCCAGCAGCAGCCCCGCTCTCGGTCTGGGAACTAATAACGATGGCTACAGGCAGT
hu.45-B    552  -CCCCAGCCTCTCGGACACAGCAGCAGCAGCAGCAGCAGCCCCGCTCTCGGTCTGGGAACTAATAACGATGGCTACAGGCAGT
hu.57-B    552  -CCCCAGCCTCTCGGACACAGCAGCAGCAGCAGCAGCAGCCCCGCTCTCGGTCTGGGAACTAATAACGATGGCTACAGGCAGT
hu.35-B    552  -CCCCAGCCTCTCGGACACAGCAGCAGCAGCAGCAGCAGCCCCGCTCTCGGTCTGGGAACTAATAACGATGGCTACAGGCAGT
hu.58-B    552  -CCCCAGCCTCTCGGACACAGCAGCAGCAGCAGCAGCAGCCCCGCTCTCGGTCTGGGAACTAATAACGATGGCTACAGGCAGT
hu.28-B    552  -CCCCAGCCTCTCGGACACAGCAGCAGCAGCAGCAGCAGCCCCGCTCTCGGTCTGGGAACTAATAACGATGGCTACAGGCAGT
hu.51-B    552  -CCCCAGCCTCTCGGACACAGCAGCAGCAGCAGCAGCAGCCCCGCTCTCGGTCTGGGAACTAATAACGATGGCTACAGGCAGT
hu.19-B    552  -CCCCAGCCTCTCGGACACAGCAGCAGCAGCAGCAGCAGCCCCGCTCTCGGTCTGGGAACTAATAACGATGGCTTCAGGCAGT
hu.49-B    552  -CCCCAGCCTCTCGGACACAGCAGCAGCAGCAGCAGCAGCCCCGCTCTCGGTCTGGGAACTAATAACGATGGCTACAGGCAGT
hu.52-B    552  -CCCCAGCCTCTCGGACACAGCAGCAGCAGCAGCAGCAGCCCCGCTCTCGGTCTGGGAACTAATAACGATGGCTACAGGCAGT
hu.13-B    552  -CCCCAGCCTCTCGGACACAGCAGCAGCAGCAGCAGCAGCCCCGCTCTCGGTCTGGGAACTAATAACGATGGCTTCAGGCAGT
```

| | | |
|---|---|---|
| rh.50-E | 625 | GGCGCACCAATGGCAGACAATAACGAAGGTGCCGACGGAGTGGGTAGTTCCTCGGGAAATTGGCATTGCG |
| rh.49-E | 625 | GGCGCACCAATGGCAGACAATAACGAAGGTGCCGACGGAGTGGGTAGTTCCTCGGGAAATTGGCATTGCG |
| rh.61-E | 625 | GGCGCACCAATGGCAGACAATAACGAAGGTGCCGACGGAGTGGGTAGTTCCTCGGGAAATTGGCATTGCG |
| hu.41-E | 625 | GGCGCTCCAATGGCAGACAATAACGAAGGCGCCGACGGAGTGGGTAGTTCCTCAGGAAATTGGCATTGCG |
| rh.64-E | 625 | GGCGCACCAATGGCAGACAATAACGAAGGTGCCGACGGAGTGGGTAGTTCCTCGGGAAATTGGCATTGCG |
| hu.42-E | 625 | GGCGCACCAATGGCAGACAATAACGAAGGCGCCGACGGAGTGGGTAGTTCCTCAGGAAATTGGCATTGCG |
| rh.57-E | 625 | GGCGCACCAATGGCAGACAATAACGAAGGTGCCGACGGAGTGGGTAGTTCCTCGGGAAATTGGCATTGCG |
| hu.40-E | 625 | GGCGCTCCAATGGCAGACAATAACGAAGGCGCCGACGGAGTGGGTAGTTCCTCAGGAAATTGGCATTGCG |
| AAV8-E | 625 | GGCGCACCAATGGCAGACAATAACGAAGGCGCCGACGGAGTGGGTAGTTCCTCGGGAAATTGGCATTGCG |
| rh.58-E | 625 | GGCGCTCCAATGGCAGACAATAACGAAGGCGCCGACGGAGTGGGTAGTTCCTCAGGAAATTGGCATTGCG |
| rh.40-E | 625 | GGCGCTCCAATGGCAGACAATAACGAAGGCGCCGACGGAGTGGGTAGTTCCTCAGGAAATTGGCATTGCG |
| hu.67-E | 625 | GGCGCTCCAATGGCAGACAATAACGAAGGCGCCGACGGAGTGGGTAGTTCCTCAGGAAATTGGCATTGCG |
| hu.17-E | 625 | GGCGCTCCAATGGCAGACAATAACGAAGGCGCCGACGGAGTGGGTAGTTCCTCAGGAAATTGGCATTGCG |
| hu.6-E | 625 | GGCGCTCCAATGGCAGACAATAACGAAGGCGCCGACGGAGTGGGTAGTTCCTCAGGAAATTGGCATTGCG |
| hu.66-E | 625 | GGCGCTCCAATGGCAGACAATAACGAAGGCGCCGACGGAGTGGGTAGTTCCTCAGGAAATTGGCATTGCG |
| rh.38-E | 625 | GGCGCTCCAATGGCAGACAATAACGAAGGCGCCGACGGAGTGGGTAGTTCCTCAGGAAATTGGCATTGCG |
| hu.32-F | 622 | GGCGCACCAGTGGCAGACAATAACGAAGGTGCCGATGGAGTGGGTAGTTCCTCGGGAAATTGGCATTGCG |
| AAV9/hu | 622 | GGCGCACCAGTGGCAGACAATAACGAAGGTGCCGATGGAGTGGGTAGTTCCTCGGGAAATTGGCATTGCG |
| hu.31-F | 622 | GGCGCACCAGTGGCAGACAATAACGAAGGTGCCGATGGAGTGGGTAGTTCCTCGGGAAATTGGCATTGCG |

| | | 710 720 730 740 750 760 770 |
|---|---|---|
| | | ....|....|....|....|....|....|....|....|....|....|....|....|....| |
| AAV5 | 662 | ATTCCACGTGGATGGGACAGAGTCGTCACCAAGTCCACCCGAACCTGGTGCTGCCCAGTCCAACAA |
| AAV3-3 | 692 | ATTCCCAATGGCTGGGACAGAGATGGCTCATCACGACCATCACCAGCACCAGGGCCCTGCCACCTTACAACAA |
| AAV4-4 | 674 | ATTCCACCTGGTCTGAGGGCTGGGCCACGTCACGAGAGTCATCACCAACACCAGAGAACCTGGTGTCTTGCCCACCTACAACAA |
| AAV1-A | 692 | ATTCCACACATGGCTGGGCCACATGGCTGACAGAGTCATCACCACCACACACCCGCACCTGGGCCTTGCCCACCTACAATAA |
| hu.46-A | 692 | ATTCCACACATGGCTGGGCGACAGAGTCATCACCACCACACACACCCGCACCTGGGCCTTGCCCACCTACAATAA |
| hu.48-A | 692 | ATTCCACACATGGCTGGGCGACAGAGTCATCACCACCACACACACCCGCACCTGGGCCTTGCCCACCTACAATAA |
| hu.44-A | 692 | ATTCCACACATGGCTGGGCGACAGAGTCATCACCACCACACACACCCGCACCTGGGCCTTGCCCACCTACAATAA |
| hu.43-A | 695 | ATTCCACACATGGCTGGGCCACAGAGTCATCACCACCACACACACCCGCACCTGGGCCTTGCCCACCTACAATAA |

FIG. 3AB

```
AAV6-A    692  ATTCCACATGGCTGGGCGACAGAGTCATCACCACCAGCACCCGAAACATGGGCCTTGCCCACCTATAACAA
hu.34-B   692  ATTCCACATGGATGGGCGACAGAGTCATCACCACCAGCACCCGAAACCTGGGCCCTGCCCACCTACAACAA
hu.47-B   692  ATTCCACATGGATGGGCGACAGAGTCATCACCACCAGCACCCGAAACCTGGGCCCTGCCCACCTACAACAA
hu.29-B   692  ATTCCACATGGATGGGCGACAGAGTCATCACCACCAGCACCCGAAACCTGGGCCCTGCCCACCTACAACAA
hu.63-B   692  ATTCCACATGGATGGGCGACAGAGTCATCACCACCAGCACCCGAAACCTGGGCCCTGCCCACCTACAACAA
hu.56-B   692  ATTCCACATGGATGGGCGACAGAGTCGTCACCACCAGCACCCGAAACCTGGGCCCTGCCCACCTACAACAA
hu.45-B   692  ATTCCACATGGATGGGCGACAGAGTCATCACCACCAGCACCCGAAACCTGGGCCCTGCCCACCTACAACAA
hu.57-B   689  ATTCCACATGGATGGGCGACAGAGTCATCACCACCAGCACCCGAAACCTGGGCCCTGCCCACCTACAACAA
hu.35-B   692  ATTCCACATGGATGGGCGACAGAGTCATCACCACCAGCACCCGAAACCTGGGCTCTGCCCACCTACAACAA
hu.58-B   692  ATTCCACATGGATGGGCGACAGAGTCATCACCACCAGCACCCGAAACCTGGGCCCTGCCCACCTACAACAA
hu.28-B   692  ATTCCACATGGATGGGCGACAGAGTCATCACCACCAGCACCCGAAACCTGGGCCCTGCCCACCTACAACAA
hu.51-B   692  ATTCCACATGGATGGGCGACAGAGTCATCACCACCAGCACCCGAAACCTGGGCCCTGCCCACCTACAACAA
hu.19-B   692  ATTCCACATGGATGGGCGACAGAGTCATCACCACCAGCACCCGAAACCTGGGCCCTGCCCACCTACAACAA
hu.49-B   692  ATTCCACATGGATGGGCGACAGAGTCATCACCACCAGCACCCGAAACCTGGGCTCTGCCCACCTACAACAA
hu.52-B   692  ATTCCACATGGATGGGCGACAGAGTCATCACCACCAGCACCCGAAACCTGGGCCCTGCCCACCTACAACAA
hu.13-B   692  ATTCCACATGGATGGGCGACAGAGTCATCACCACCAGCACCCGAAACTTGGGCCCTGCCCACCTACAACAA
AAV2-B    692  ATTCCACATGGATGGGCGACAGAGTCATCACCACCAGCACCCGAAACCTGGGCCCTGCCCACCTACAACAA
hu.20-B   692  ATTCCACATGGATGGGCGACAGAGTCATCACCACCAGCACCCGAAACCTGGGCCCTGCCCACCTACAACAA
hu.24-B   692  ATTCCACATGGATGGGCGACAGAGTCATCACCACCAGCACCCGAAACCTGGGCCCTGCCCACCTACAACAA
hu.64-B   692  ATTCCACATGGATGGGCGACAGAGTCATCACCACCAGCACCCGAAACCTGGGCCCTGCCCACCTACAACAA
hu.27-B   692  ATTCCACATGGATGGGCGACAGAGTCATCACCACCAGCACCCGAAACCTGGGCCCTGCCCACCTACAACAA
hu.21-B   692  ATTCCACATGGATGGGCGACAGAGTCATCACCACCAGCACCCGAAACCTGGGCCCTGCCCACCTACAACAA
hu.22-B   692  ATTCCACATGGATGGGCGACAGAGTCATCACCACCAGCACCCGAAACCTGGGCCCTGCCCACCTACAACAA
hu.23-B   692  ATTCCACATGGCTGGGCGACAGAGTCATCACCACCAGCACCCGAAACCTGGGCCCTGCCCACCTACAACAA
hu.7-C    692  ATTCCCAATGGCTGGGCGACAGAGTCATCACCACCAGCACCCGAAACCTGGGCCCTGCCCACCTACAACAA
hu.61-C   692  ATTCCCAATGGCTGGGCGACAGAGTCATCACCACCAGCACCCGAACCTGGGCCCTGCCCACCTACAACAA
rh.56-C   692  ATTCCCAATGGCTGGGCGACAGAGTCATCACCACCAGCACCCGAACCTGGGCAGCCTGCCCACCTACAACAA
hu.9-C    692  ATTCCCAATGGCTGGGCGACAGAGTCATCACCACCAGCACCCGAACCTGGGCCCTGCCCACCTACAACAA
hu.54-C   692  ATTCCCAATGGCTGGGCGACAGAGTCATCACCACCAGCACCCGAACCTGGGCCCTGCCCACCTACAACAA
hu.53-C   692  ATTCCCAATGGCTGGGCGACAGAGTCATCACCACCAGCACCCGAACCACCGAACCTGGGCCCTGCCCACCTACAACAA
```

FIG. 3AC

| | | |
|---|---|---|
| hu.60-C | 692 | ATTCCCAATGGCTGGGCGACAGAGTCATCACCACCAGCACCCGCACCTGGGCCCTGCCCACCTACAACAA |
| hu.55-C | 692 | ATTCCCAATGGCTGGGCGACAGAGTCATCATCACCACCAGCACCAGCACCTGGGCCCTGCCCACCTACAACAA |
| hu.2-C | 692 | ATTCCCAATGGCTGGGCGACAGAGTCATCATCACCACCAGCACCAGCACCTGGGCCCTGCCCACATACAACAA |
| hu.1-C | 692 | ATTCCCAATGGCTGGGCGACAGAGTCATCATCACCACCAGCACCAGCACCTGGGCCCTGCCCACATACAACAA |
| hu.18-C | 692 | ATTCCCAATGGCTGGGCGACAGAGTCATCATCACCACCAGCACCAGCACCTGGGCCCTGCCCACCTACAACAA |
| hu.3-C | 695 | ATTCCCAATGGCTGGGCTGACGACAGAGTCATCATCACCACCAGCACCAGCACCTGGGCCCTGCCCACATACAACAA |
| hu.25-C | 692 | ATTCCCAATGGCTGGGCGACGACAGAGTCATCATCACCACCAAGCACTGGCACCTGGGCCCTGCCCACCTACAACAA |
| hu.15-C | 692 | ATTCCCAATGGCTGGGCGACAGAGTCATCATCACCACCAGCACCAGCACCTGGGCTCTGCCCACCTACAATAA |
| hu.16-C | 692 | ATTCCCAATGGCTGGGCGACAGAGTCATCATCACCACCAGCACCAGCACCTGGGCTCTGCCCACCTACAACAA |
| hu.11-C | 692 | ATTCCCAATGGCTGGGCGACAGAGTCATCATCACCACCAGCACCAGCACCTGGGCCCTGCCCACCTACAACAA |
| hu.10-C | 692 | ATTCCCAATGGCTGGGCGACAGAGTCATCATCACCACCAGCACCAGCACCTGGGCCCTGCCCACATACAACAA |
| hu.4-C | 692 | ATTCCCAATGGCTGGGCGACAGAGTCATCATCACCACCAGCACCAGCACCTGGGCCCTGCCCACCTACAACAA |
| rh.54-D | 695 | ATTCCACATGGCTGGGCGACAGAGTCATCATCACCACCAGCACCAGCACCTGGGCTTTGCCCACCTACAACAA |
| rh.48-D | 695 | ATTCCACATGGCTGGGCGACAGAGTCATCATCACCACCAGCACCAGCACCTGGGCTTTGCCCACCTACAACAA |
| rh.55-D | 695 | ATTCCACACGGCTGGGCGACAGAGTCATCATCACCACCAGCACCAGCACCTGGGCTTTGCCCACCTACAACAA |
| rh.62-D | 695 | ATTCCACATGGCTGGGCGACAGAGTCATCATCACCACCAGCACCAGCACCTGGGCCCTGCCCACCTACAACAA |
| AAV7-D | 695 | ATTCCACATGGCTGGGCGACAGAGTCATTACCACCAGCACCAGCACCTGGGCCCTGCCCACCTACAACAA |
| rh.52-E | 695 | ATTCCACATGGCTGGGCGACAGAGTCATCATCACCACCAGCACCAGCACCTGGGCCCTGCCCACCTACAACAA |
| rh.51-E | 695 | ATTCCACATGGCTGGGCGACAGAGTCATCATCACCACCAGCACCAGCACCTGGGCCCTGCCCACCTACAACAA |
| hu.39-E | 695 | ATTCCACATGGCTGGGCGACAGAGTTATCATCACCACCAGCACCAGCACCTGGGCCCTGCCCACCTACAACAA |
| rh.53-E | 695 | ATTCCACATGGCTGGGCGACAGAGTCATCATCACCACCAGCACCAGCACCTGGGCCCTGCCCACCTACAACAA |
| rh.37-E | 695 | ATTCCACATGGCTGGGCGACAGAGTCATCATCACCACCAGCACCAGCACCTGGGCCCTGCCCACCTACAACAA |
| hu.43-E | 692 | ATTCCACATGGCTGGGCGACAGAGTCATCATCACCACCAGCACCAGCACCTGGGCCCTGCCCACCTACAACAA |
| rh.50-E | 695 | ATTCCACATGGCTGGGCGACAGAGTCATCATCACCACCAGCACCAGCACCTGGGCCCTGCCCACCTACAACAA |
| rh.49-E | 695 | ATTCCACATGGCTGGGCGACAGAGTCATCATCACCACCAGCACCAGCACCTGGGCCCTGCCCACCTACAACAA |
| rh.61-E | 695 | ATTCCACATGGCTGGGCGACAGAGTCATCATCACCACCAGCACCAGCACCTGGGCCCTGCCCACCTACAACAA |
| hu.41-E | 695 | ATTCCACATGGCTGGGCGACAGAGTCATCATCACCACCAGCACCAGCACCTGGGCCCTGCCCACCTACAACAA |
| rh.64-E | 695 | ATTCCACATGGCTGGGCGACAGAGTCATCATCACCACCAGCACCAGCACCTGGGCCCTGCCCACCTACAACAA |
| hu.42-E | 695 | ATTCCACATGGCTGGGCGACAGAGTCATCATCACCACCAGCACCAGCACCTGGGCCCTGCCCACCTACAACAA |
| rh.57-E | 695 | ATTCCACATGGCTGGGCGACAGAGTCATCATCACCACCAGCACCAGCACCTGGGCCCTGCCCACCTACAACAA |

| | | |
|---|---|---|
| hu.66-E | 765 | CCACCCTCTACAAGCAAATATCCAATGGGACATCGGGAGGAAGCACCAACGACAACACCTACTTCGGCTAC |
| rh.38-E | 765 | CCACCCTCTACAAGCAAATATCCAATGGGACATCGGGAGGAAGCACCAACGACAACACCTACTTCGGCTAC |
| hu.32-F | 762 | TCACCCTCTACAAGCAAATCTCCAACAGCAGCACCAACGACAACACCTACTTCGGCTAC |
| AAV9/hu | 762 | TCACCCTCTACAAGCAAATCTCCAACAGCAGCACCAACGACAACGCCTACTTCGGCTAC |
| hu.31-F | 762 | TCACCCTCTACAAGCAAATCTCCAACAGCAGCACCAACGACAACGCCTACTTCGGCTAC |

```
                 850       860       870       880       890       900       910
        ....|....|....|....|....|....|....|....|....|....|....|....|....|....|
AAV5    799 AGCACCCCCTGGGGTACTTTGACTTTAACCGCTTCCACAGCCACTGCCACTGCCACTTCCACACGTGGACTGGCAGCAAAGAC

```



| | | |
|---|---|---|
| AAV5 | 799 | AGCACCCCCTGGGGTACTTTGACTTTAACCGCTTCCACAGCCACTGCCACTGCCACTTCCACACGTGGACTGAGCCCGAGACTGGCAGCAAAGAC |
| AAV3-3 | 826 | AGCACCCCCTTGGGGTATTTGACTTTGACTTTAACAGATTCCACTGCCACTGCCACTTCTCACCACGTGGACTGACTGGCAGCAAAGAC |
| AAV4-4 | 799 | TCCACCCCCTGGGGATACTTTGACTTCAACCGCTTCCAACAGATTCCACTGCCACTTTCACCACGTGGACTGACTGGCAGCAAAGAC |
| AAV1-A | 829 | AGCACCCCCTGGGGTATTTGATTTGATTTGATTTCAACAGATTCCACTGCCACTTTCACCACGTGGACTGACTGGCAGCAAAGAC |
| hu.46-A | 829 | AGCACCCCCTGGGGTATTTGATTTGATTTCAACAGATTCCACTGCCACTTTCACCACGTGGACTGACTGGCAGCAAAGAC |
| hu.48-A | 829 | GGCACCCCCTGGGGTATTTGATTTTGATTTCAACAGATTCCACTGCCACTTTCACCACGTGGACTGACTGGCAGCAAAGAC |
| hu.44-A | 829 | AGCACCCCCTGGGGTATTTGATTTGATTTGATTTCAACAGATTCCACTGCCACTTTCACCACGTGGACTGACTGGCAGCAAAGAC |
| hu.43-A | 832 | AGCACCCCCTGGGGTATTTGATTTTGATTTCAACAGATTCCACTGCCACTTTCACCACGTGGACTGACTGGCAGCAAAGAC |
| AAV6-A | 829 | AGCACCCCCTGGGGTATTTGATTTTGATTTCAACAGATTCCACTGCCATTTCTCACCACGTGGACTGACTGGCAAAGAC |
| hu.34-B | 826 | AGCACCCCCTTGGGGTATTTGACTTTGACTTTCAACAGATTCCACTGCCACTTTTCACCACGTGGACTGACTGGCAAAGAC |
| hu.47-B | 826 | AGCACCCCCTTGGGGTATTTGACTTTGACTTTCAACAGATTCCACTGCCACTTTTCACCACGTGGACTGACTGGCAAAGAC |
| hu.29-B | 826 | AGCACCCCCTTGGGGTATTTGACTTTGACTTTCAACAGATTCCACTGCCACTTTTCACCACGTGGACTGACTGGCAAAGAC |
| hu.63-B | 826 | AGCACCCCCTTGGGGTATTTGACTTTGACTTTCAACAGATTCCACTGCCACTTTTCGCCACGTGGACTGACTGGCAAAGAC |
| hu.56-B | 826 | AGCACCCCCTTGGGGTATTTGACTTTGACTTTCAACAGATTCCACTGCCACTTTTCGCCACGTGGACTGACTGGCAAAGAC |
| hu.45-B | 826 | AGCACCCCCTTGGGGTATTTGACTTTGACTTTCAACAGATTCCACTGCCACTTTTCGCCACGTGGACTGACTGGCAAAGAC |
| hu.57-B | 823 | AGCACCCCCTTGGGGTATTTGACTTTGACTTTCAACAGATTCCACTGCCACTTTTCGCCACGTGGACTGACTGGCAAAGAC |
| hu.35-B | 826 | AGCACCCCCTTGGGGTATTTGACTTTGACTTTCAACAGATTCCACTGCCACTTTTCACCACGTGGACTGACTGGCAAAGAC |
| hu.58-B | 826 | AGCACCCCCTTGGGGTATTTGACTTTGACTTTCAACAGATTCCACTGCCACTTTTCACCACGTGGACTGACTGGCAAAGAC |
| hu.28-B | 826 | AGCACCCCCTTGGGGTATTTGACTTTGACTTTCAACAGATTCCACTGCCACTTTTCACCACGTGGACTGACTGGCAAAGAC |
| hu.51-B | 826 | AGCACCCCCTTGGGGTATTTGACTTTGACTTTCAACAGATTCCACTGCCACTCTCCCCACGTGGACTGACTGGCAAAGAC |
| hu.19-B | 826 | AGCACCCCCTTGGGGTATTTGACTTTGACTTTCAACAGATTCCACTGCCACTTTTCACCACGTGGACTGACTGGCAAAGAC |
| hu.49-B | 826 | AGCACCCCCTTGGGGTATTTGACTTTGACTTTCAACAGATTCCACTGCCACTTTTCACCACGTGGACTGACTGGCAAAGAC |

```
AAV5       869  ........|........|........|........|........|........|........|
AAV3-3     896  TCATCAACAACTACTGGGCTTCCGGATTCCGGCCAAGACCCCGTCCCTCAGAGTCAAGAAATCTTCAACATTCAAGTCAAAGA
AAV4-4     869  TCATTAACAACAACTGGGAACTGGGCATGCGACCCAAGAAACTCAGCTTCCGGCCCAAGAAACTCAGCTTCAACATCCAAGTTAGAGG
AAV1-A     899  TCATCAACAACAACTGGGCATGGGGCATGCGACCCAAGAGCCAAGGCCGCCGATCCGGCCCAAGAGACTCAACTTCAAAATCTTCAACATCCAAGTCAAGGA
hu.46-A    899  TCATCAACAACAACAATTGGGGATTCCGGCCCAAGAGACTCAACTTCAAACTCTTCAACATCTTCAACATCCAAGTCAAGGA
hu.48-A    899  TCATCAACAACAACAATTGGGGATTCCGGCCCAAGAGACTCAACTTCAAACTCTTCAACATCTTCAACATCCAAGTCAAGGA
hu.44-A    899  TCATCAACAACAACAATTGGGGATTCCGGCCCAAGAGACTCAACTTCAAACTCTTCAACATCTTCAACATCCAAGTCAAGGA
hu.43-A    902  TCATCAACAACAACAATTGGGGATTCCGGCCCAAGAGACTCAACTTCAAACTCTTCAACATCTTCAACATCCAAGTCAAGGA
AAV6-A     899  TCATCAACAACAACAATTGGGGATTCCGGCCCAAGAGACTCAACTTCAAACTCTTCAACATCTTCAACATCCAAGTCAAGGA
hu.34-B    896  TCATCAACAACAACAACTGGGGATTCCGACCCAAGAGACTCAACTTCAAGCTCTCTTTAACATTCAAGTCAAGGA
hu.47-B    896  TCATCAACAACAACAACTGGGGATTCCGACCCAAGAGACTCAACTTCAAGCTCTCTTTAACATTCAAGTCAAAGA
hu.29-B    896  TCATCAACAACAACAACTGGGGATTCCGACCCAAGAGACTCAACTTCAAGCTCTCTTTAACATTCAAGTCAAAGA
hu.63-B    896  TCATCAACAACAACAACTGGGGATTCCGACCCAAGAGACTCAACTTCAAGCTCTTTAACATTCAAGTCAAAGA
hu.56-B    896  TCATCAACAACAACAACTGGGGATTCCGACCCAAGAGACTCAACTTCAAGCTCTGTTTAACATTCAAGTCAAAGA
hu.45-B    896  TCATCAACAACAACAACTGGGGATTCCGACCCAAGAGACTCAACTTCAAGCTCTGTTTAACATTCAAGTCAAAGA
hu.57-B    893  TCATCAACAACAACAACTGGGGATTCCGACCCAAGAGACTCAACCTCAAGCTTCTCTTTAACATTCAAGTCAAAGA
hu.35-B    896  TCATCAACAACAACAACTGGGGATTCCGACCCAAGAGACTCAACTTCAGCTCTCTTTAACATTCAAGTCAAAGA
hu.58-B    896  TCATCAACAACAACAACTGGGGATTCCGACCCAAGAGACTCAACTTCAGCTCTCTTTAACATTCAAGTCAAAGA
hu.28-B    896  TCATCAACAACAACAACTGGGGATTCCGACCCAAGAGACTCAACTTCAGCTCTCTTTAACATTCAAGTCAAAGA
hu.51-B    896  TCATCAACAACAACAACTGGGGATTCCGACCCAAGAGACTCAACTTCAGCTCTCTTTAACATTCAAGTCAAAGA
hu.19-B    896  TCATCAACAACAACAACTGGGGATTCCGACCCAAGAGACTCAACTTCAGCTCTCTTTAACATTCAAGTCAAAGA
hu.49-B    896  TCATCAACAACAACAACTGGGGATTCCGACCCAAGAGACTCAACTTCAGCTCTCTTTAACATTCAAGTCAAAGA
hu.52-B    896  TCATCAACAACAACAACTGGGGATTCCGACCCAAGAGACTCAACTTCAGCTCTCTTTAACATTCAAGTCAAAGA
hu.13-B    896  TCATCAACAACAACAACTGGGGATTCCGACCCAAGAGACTCAACTTCAGCTTCTCTTTAACATTCAAGTCAAAGA
AAV2-B     896  TCATCAACAACAACAACTGGGGATTCCGACCCAAGAGACTCAACTTCAGCTTCTCTTTAACATTCAAGTCAAAGA
hu.20-B    896  TCATCAACAACAACAACTGGGGATTCCGACCCAAGAGACTCAACTTCAGCTTCTCTTTAACATTCAAGTCAAAGA
hu.24-B    896  TCATCAACAACAACAACTGGGGATTCCGACCCAAGAGACTCAACTTCAGCTTCTCTTTAACATTCAAGTCAAAGA
hu.64-B    896  TCATCAACAACAACAACTGGGGATCCCGGCCCAAGAAAGACTCAACTTCAGCTTCTCTTTAACATTCAAGTCAAAGA
hu.27-B    896  TCATCAACAACAACAACTGGGGATTCCGGCCCAAGAGACTCAACTTCAGCTTCTCTTTAACATTCAAGTCAAAGA
```

FIG. 3AK

```
hu.21-B   896  TCATCAACAACAACAACTGGGGATTCCGGCCCAAGAGACTCAGCTTCAAGCTCTCTTTAACATTCAAGTCAAGTCAAAGA
hu.22-B   896  TCATCAACAACAACAACTGGGGATTCCGGCCCAAGAGACTCAGCTTCAAGCTTCAGCTTCTCTTTAACATTCAAGTCAAGTCAAAGA
hu.23-B   896  TCATCAACAACAACAACTGGGGATTCCGGCCCAAGAGACTCAGCTTCAAGCTTCAGCTTCTCTTTAACATTCAAGTCAAGTCAAAGA
hu.7-C    896  TCATCAACAACAACAACTGGGGATTCCGACCCAAGAGACTCAGCTTCAACTTCAAGCTCTCTTTAACATTCAAGTCAAGTCAAAGA
hu.61-C   896  TCATCAACAACAACAACTGGGGATTCCGACCCAAGAGACTCAGCTTCAACTTCAAGCTCTCTTTAACATTCAAGTCAAGTCAAAGA
rh.56-C   896  TCATCAACAACAACAACTGGGGATTCCGACCCAAGAGACTCAGCTTCAACTTCAAGCTCTCTTTAACATTCAAGTCAAGTCAAAGA
hu.9-C    896  TCATCAACAACAACAACTGGGGATTCCGACCCAAGAGACTCAGCTTCAACTTCAAGCTTCTCTTTAACATTCAAGTCAAGTCAAAGA
hu.54-C   896  TCATCAACAACAACAACTGGGGATTCCGACCCAAGAGACTCAGCTTCAACTTCAAGCTCTCTTTAACATTCAAGTCAAGTCAAAGA
hu.53-C   896  TCATCAACAACAACAACTGGGGATTCCGACCCAAGAGACTCAGCTTCAACTTCAAGCTCTCTTTAACATTCAAGTCAAGTCAAAGA
hu.60-C   896  TCATCAACAACAACAACTGGGGATTCCGACCCAAGAGACTCAGCTTCAACTTCAAGCTCTCTTTAACATTCAAGTCAAGTCAAAGA
hu.55-C   896  TCATCAACAACAACAACTGGGGATTCCGACCCAAGAGACTCAGCTTCAACTTCAAGCTCTCTTTAACATTCAAGTCAAGTCAAAGA
hu.2-C    896  TCATCAACAACAACAACTGGGGATTCCGGCCCAAAAGACTCAACTTCAAGCTCTCTTTAACATTCAAGTCAAGTCAAAGA
hu.1-C    896  TCATCAACAACAACAACTGGGGATTCCGGCCCAAAAGACTCAACTTCAAGCTCTCTTTAATATTCAAGTCAAGTCAAAGA
hu.18-C   896  TCATCAACAACAACAGCAACTGGGGATTCCGGCCCAAGAGACTCAACTTCAAGCTCTCTTTAACATTCAAGTCAAGTCAAAGA
hu.3-C    899  TCGTCAACAACAACAACTGGGGATTCCGGCCCAAGAGACTCAACTTCAAGCTCTCTTTAATATTCAAGTCAAGTCAAAGA
hu.25-C   896  TCATCAACAACAACAACTGGGGATTCCGACCCAAGAGACTCAACTTCAAGCTCTCTTTAACATTCAAGTCAAGTCAAAGA
hu.15-C   896  TCATCAACAACAACAACTGGGGATTCCGACCCAAGAAAGACTCAACTTCAAGCTCTCTTTAACATTCAAGTCAAGTCAAAGA
hu.16-C   896  TCATCAACAACAACAACTGGGGATTCCGACCCAAGAGACTCAACTTCAAGCTCTCTTTAACATTCAAGTCAAGTCAAAGA
hu.11-C   896  TCATCAACAACAACAACTGGGGATTCCGACCCAAGAGACTCAACTTCAAGCTCTCTTTAACATTCAAGTCAAGTCAAGGA
hu.10-C   896  TCATCAACAACAACAACTGGGGATTCCGGCCCAAGAGACTCAACTTCAAGCTCTCTTTAACATTCAAGTCAAGTCAAAGA
hu.4-C    896  TCATCAACAACAACAACCGGGGATTCCGGCCCAAGAGAAGCTCAACTTCAAGCTCTCTTTAATATTCAAGTCAAGTCAAAGA
rh.54-D   902  TCATCAACAACAACAACTGGGGATTCCGGCCCAAGAGAAGCTCAGCTTCAACATCCAAGTCAAGGA
rh.48-D   902  TCATCAACAACAACAACTGGGGATTCCGGCCCAAGAGAAGCTCAGCTTCAACATCCAGTCAAGGA
rh.55-D   902  TCATCAACAACAACAACTGGGGATTCCGGCCCAAGAGAAGCTCAGCTTCAACATCCAGTCAAGGA
rh.62-D   902  TCATCAACAACAACAACTGGGGATTCCGGCCCAAGAGAAGCTCAGCTTCAACATCCAGTCAAGGA
AAV7-D    902  TCATCAACAACAACAACTGGGGATTCCGGCCCAAGAGAAGCTGCGGTTCAGCTTCAACATCCAGTCAAGGA
rh.52-E   905  TCATCAACAACAACAACTGGGGATTCCGGCCCAAGAGACTCAGCTTCAACATCCAGTCAAAGA
rh.51-E   905  TCATCAACAACAACAACTGGGGATTCCGGCCCAAGAGACTCAGCTTCAACATCCAGTCAAGGA
hu.39-E   905  TCATCAACAACAACAACTGGGGATTCCGGCCCAAGAGACTCAGCTTCAACATCCAGTCAAGGA
rh.53-E   905  TCATCAACAACAACAACTGGGGATTCCGGCCCAAGAGACTCAGCTTCAACATCCAGTCAAGGA
```

| hu.44-A | 969 | GGTCACGACGAATGATGGCGTCACAACCATCGCTAATAACCTTACCAGCACGGTTCAAGTCTTCTCGGAC |
| hu.43-A | 972 | GGTCACGACGAATGATGGCGTCACAACCATCGCTAATAACCTTACCAGCACGGTTCAAGTCTTCTCGGAC |
| AAV6-A | 969 | GGTCACGACGAATGATGGCGTCACGACCATCGCTAATAACCTTACCAGCACGGTTCAAGTCTTCTCGGAC |
| hu.34-B | 966 | GGTCACGCAGCGAATGACGGTACGACGACGATTGCCAATAACCTTACCAGCACGGTTCAGTGTTACTGAC |
| hu.47-B | 966 | GGTCACGCAGCGAATGACGGTACGACGACGATTGCCAATAACCTTACCAGCACGGTTCAGTGTTACTGAC |
| hu.29-B | 966 | GGTCACGCAGCGAATGACGGTACGACGACGATTGCCAATAACCTTACCAGCACGGTTCAGTGTTTACTGAC |
| hu.63-B | 966 | GGTCACGCAGCGAATGACGGTACGACGACGATTGCCAATAACCTTACCAGCACGGTTCAGTGTTTACTGAC |
| hu.56-B | 966 | GGTCACGCAGCGAATGACGGTACGACGACGATTGCCAATAACCTTACCAGCACGGTTCAGTGTTTACTGAC |
| hu.45-B | 966 | GGTCACGCAGCGAATGACGGTACGACGACGATTGCCAATAACCTTACCAGCACGGTTCAGTGTTTACTGAC |
| hu.57-B | 963 | GGTCACGCAGCGAATGACGGTACGACGACGATTGCCAATAACCTTACCAGCACGGTTCAGTGTTTACTGAC |
| hu.35-B | 966 | GGTCACGCAGCGAATGACGGTACGACGACGATTGCCAATAACCTTACCAGCACGGTTCAGTGTTTACTGAC |
| hu.58-B | 966 | GGTCACGCAGCGAATGATGGTACGACGACGATTGCCAATAACCTTACCAGCACGGTTCAGTGTTTACTGAC |
| hu.28-B | 966 | GGTCACGCAGCGAATGACGGTACGACGACGATTGCCAATAACCTTACCAGCACGGTTCAGTGTTTACTGAC |
| hu.51-B | 966 | GGTCACGCAGCGAATGACGGTACGACGACGATTGCCAATAACCTTACCAGCACGGTTCAGTGTTTACTGAC |
| hu.19-B | 966 | GGTCACGCAGCGAATGACGGTACGACGACGATTGCCAATAACCTTACCAGCACGGTTCAGTGTTTACTGAC |
| hu.49-B | 966 | GGTCACGCAGCGAATGACGGTACGACGACGATTGCCAATAACCTTACCAGCACGGTTCAGTGTTTACTGAC |
| hu.52-B | 966 | GGTCACGCAGCGAATGACGGTACGACGACGATTGCCAATAACCTTACCAGCACGGTTCAGTGTTTACTGAC |
| hu.13-B | 966 | GGTCACGCAGCGAATGACGGTACGACGACGATTGCCAATAACCTTACCAGCACGGTTCAGTGTTTACTGAC |
| AAV2-B | 966 | GGTCACGCAGCGAATGACGGTACGACGACGATTGCCAATAACCTTACCAGCACGGTTCAGTGTTTACTGAC |
| hu.20-B | 966 | GGTCACGCAGCGAATGACGGTACGACGACGATTGCCAATAACCTTACCAGCACGGTTCAGTGTTTACTGAC |
| hu.24-B | 966 | GGTCACGCAGCGAATGACGGTACGACGACGATTGCCAATAACCTTACCAGCACGGTTCAGTGTTTACTGAC |
| hu.64-B | 966 | GGTCACGCAGCGAATGACGGTACGACGACGATTGCCAATAACCTTACCAGCACGGTTCAGTGTTTACTGAC |
| hu.27-B | 966 | GGTCACGCAGCGAATGACGGTACGACGACGATTGCCAATAACCTTACCAGCACGGTTCAGTGTTTACTGAC |
| hu.21-B | 966 | GGTCACGCAGCGAATGACGGTACGACGACGATTGCCAATAACCTTACCAGCACGGTTCAGTGTTTACTGAC |
| hu.22-B | 966 | GGTCACGCAGCGAATGACGGTACGACGACGATTGCCAATAACCTTACCAGCACGGTTCAGTGTTTACTGAC |
| hu.23-B | 966 | GGTCACGCAGCGAATGACGGTACGACGACGATTGCCAATAACCTTACCAGCACGGTTCAGTGTTTACTGAC |
| hu.7-C | 966 | GGTCACGCAGCGAATGACGGTACGACGACGATTGCCAATAACCTTACCAGCACGGTTCAGTGTTTACTGAC |
| hu.61-C | 966 | GGTCACGCAGCGAATGACGGTACGACGACGATTGCCAATAACCTTACCAGCACGGTTCAGTGTTTACTGAC |
| rh.56-C | 966 | GGTCACGCAGCGAATGACGGTACGACGACGATTGCCAATAACCTTACCAGCACGGTTCAGTGTTTACTGAC |
| hu.9-C | 966 | GGTCACGCAGCGAATGACGGTACGACGACGATTGCCAATAACCTTACCAGCACGGTTCAGTGTTTACTGAC |

```
hu.19-B    1106  TCTTCATGGTGCCACAGTATGGATACCTCACCCTGAACAACGGC----------------AGTCAGGCGGTAGGACG
hu.49-B    1106  TCTTCATGGTGCCACAGTATGGATACCTCACCCTGAACAACGGG----------------AGTCAGGCAGTAGGACG
hu.52-B    1106  TCTTCATGGTGCCACAGTATGGATACCTCACCCTGAGCAACGGG----------------AGTCAGGCAGTAGGACG
hu.13-B    1106  TCTTCATGGTGCCACAGTATGGATACCTCACCCTGAACAACGGG----------------AGTCAGGCAGTAGGACG
AAV2-B     1106  TCTTCATGGTGCCACAGTATGGATACCTCACCCTGAACAACGGG----------------AGTCAGGCAGTAGGACG
hu.20-B    1106  TCTTCATGGTGCCACAGTATGGATACCTCACCCTGAACAACGGC----------------AGTCAGGCGGTAGGACG
hu.24-B    1106  TCTTCATGGTGCCACAGTATGGATACCTCACCCTGAACAACGGC----------------AGTCAGGCGGTAGGACG
hu.64-B    1106  TCTTCATGGTGCCACAGTATGGATACCTCACCCTGAACAACGGG----------------AGTCAGGCAGTAGGACG
hu.27-B    1106  TCTTCATGGTGCCACAGTATGGATACCTCACCCTGAACAACGGC----------------AGTCAGGCGGTAGGACG
hu.21-B    1106  TCTTCATGGTGCCACAGTATGGATACCTCACCCTGAACAACGGC----------------AGTCAGGCGGTAGGACG
hu.22-B    1106  TCTTCATGGTGCCACAGTATGGATACCTCACCCTGAACAACGGC----------------AGTCAGGCGGTAGGACG
hu.23-B    1106  TCTTCATGGTGCCACAGTATGGATACCTCACCCTGAACAACGGC----------------AGTCAGGCGGTAGGACG
hu.7-C     1106  TCTTCATGGTGCCCACAGTATGGATACCTCACCCTGAACAACGGG----------------AGTCAGGCAGTAGGACG
hu.61-C    1106  TCTTCATGGTCCCACAGTATGGATACCTCACCCTGAACAACGGG----------------AGTCAGGCAGTAGGACG
hu.56-C    1106  TCTTCATGGTCCCACAGTATGGATACCTCACCCTGAACAACGGG----------------AGTCAGGCAGTAGGACG
rh.9-C     1106  TCTTCATGGTCCCACAGTATGGATACCTCACCCTGAACAACGGG----------------AGTCAGGCAGTAGGACG
hu.54-C    1106  TCTTCATGGTCCCACAGTATGGATACCTCACCCTGAACAACGGG----------------AGTCAGGCAGTAGGACG
hu.53-C    1106  TCTTCATGGTCCCACAGTATGGATACCTCACCCTGAACAACGGG----------------AGTCAGGCAGTAGGACG
hu.60-C    1106  TCTTCATGGTCCCACAGTATGGATACCTCACCCTGAACAACGGG----------------AGTCAGGCAGTAGGACG
hu.55-C    1106  TCTTCATGGTCCCACAGTATGGATACCTCACCCTGAACAACGGG----------------AGTCAGGCAGTAGGACG
hu.2-C     1106  TCTTCATGGTCCCACAGTATGGATACCTCACCCTGAACAACGGG----------------AGTCAGGCAGTAGGACG
hu.1-C     1106  TCTTCATGGTCCCACAGTATGGATACCTCACCCTGAACAACGGG----------------AGTCAGGCAGTAGGACG
hu.18-C    1109  TCTTTATGGTCCCACAGTATGGATACCTCACCCTGAACAACGGG----------------AGTCAGGCGGTAGGACG
hu.3-C     1106  TCTTCATGGTCCCACAGTATGGATACCTCACCCTGAACAACGGG----------------AGTCAGGCGGTAGGACG
hu.25-C    1106  TCTTCATGGTGCCACAGTATGGATACCTCACCCTGAACAACGGG----------------AGTCAGGCGGTAGGACG
hu.15-C    1106  TCTTCATGGTGCCACAGTATGGATACCTCACCCTGAACAACGGG----------------AGTCAGGCGGTAGGACG
hu.16-C    1106  TCTTCATGGTGCCACAGTATGGATACCTCACCCTGAACAACGGG----------------AGTCAGGCGGTAGGACG
hu.11-C    1106  TCTTCATGGTCCCACAGTATGGATACCTCACCCTGAACAACGGG----------------AGTCAGGCGGTAGGACG
hu.10-C    1106  TCTTCACGGTCCCACAGTATGGATACCTCACCCTGAACAACGGG----------------AGTCAGGCGGTAGGACG
hu.4-C     1106  TCTTCATGGTCCCACAGTATGGATACCTCACCCTGAACAACGGG----------------AGTCAGGCGGTAGGACG
```

| | | |
|---|---|---|
| hu.39-E | 1176 | TTCCTCCTTCCTTCTACTGCCTGGAGTACTTCCCCTCTCAGATGCTGAGAACGGGCAACAACTTTCCTTCAGC |
| rh.53-E | 1176 | TTCCTCCTTCCTTCTACTGCCTGGAGTACTTCCCCTCTCAGATGCTGAGAACGGGCAACAACTTTCCTTCAGC |
| rh.37-E | 1176 | TTCCTCCTTCCTTCTACTGCCTGGAGTACTTCCCCTCTCAGATGCTGAGAACGGGCAACAACAATTTGAATTCAGC |
| rh.43-E | 1173 | CTCCTCCTTCCTTCTACTGCCTGGAATATTTCCTTCGCAGATGCTGAGAACGGGCAACAACTTCCAGTTTACT |
| rh.50-E | 1176 | TTCCTCCTTCCTTCTACTGCCTGGAGTACTTCCCCTCTCAGATGCTGAGAACGGGCAACAACTTTCCTTCAGC |
| rh.49-E | 1176 | TTCCTCCTTCCTTCTACTGCCTGGAGTACTTCCCCTCTCAGATGCTGAGAACGGGCAACAACTTTCCTTCAGC |
| rh.61-E | 1176 | TTCCTCCTTCCTTCTACTGCCTGGAGTACTTCCCCTCTCAGATGCTGAGAACGGGCAACAACTTTCCTTCAGC |
| hu.41-E | 1176 | TTCCTCCTTCCTTCTACTGCCTGGAATATTTCCATCTCAAATGCTGAGAACGGGCAACTGGAAACAATTTGAATTCAGC |
| rh.64-E | 1176 | TTCCTCCTTCCTTCTACTGCCTGGAATATTTCCATCTCAAATGCTGAGAACGGGCAACTGGAAACAATTTGAATTCAGC |
| hu.42-E | 1176 | TTCCTCCTTCCTTCTACTGCCTGGAGTACTTCCCATCTCAAATGCTGAGAACGGGCAACAACTTTCCTTCAGC |
| rh.57-E | 1176 | TTCCTCCTTCCTTCTACTGCCTGGAGTACTTCCCCTCTCAAATGCTGAGAACGGGCAACAACTTTCCTTCAGC |
| hu.40-E | 1176 | TTCCTCCTTCCTTCTACTGCCTGGAATATTTCCTTCGCAGATGCTGAGAACGGGCAACAACTCTGAATTCAGC |
| AAV8-E | 1176 | CTCCTCCTTCCTTCTACTGCCTGGAGTACTTCCTTCCCCTCTCAGATGCTGAGAACGGGCAACAACTTTCCTTCACT |
| rh.58-E | 1176 | TTCCTCCTTCCTTCTACTGCCTGGAATATTTCCATCTCAAATGCTGAGAACGGGCAACAACTTTCCTTCAGC |
| rh.40-E | 1176 | TTCCTCCTTCCTTCTACTGCCTGGAATATTTCCATCTCAAATGCTGAGAACGGGCAACTGGAAACAATTTGAATTCAGC |
| rh.67-E | 1176 | TTCCTCCTTCCTTCTACTGCCTGGAATATTTCCATCTCAAATGCTGAGAACGGGCAACTGGAAACAATTTGAATTCAGC |
| hu.17-E | 1176 | TTCCTCCTTCCTTCTACTGCCTGCCTGCCTGCCTCCATCTCCTTCTTCCATCTCAAATGCGGAGAACGGGCAACTGGAGTTCAGC |
| hu.6-E | 1176 | TTCCTCCTTCCTTCTACTGCCTGCCTGCCTGCCTCCATCTCCTTCTTCCATCTCAAATGCGGAGAACGGGCAACTGGAGTTCAGC |
| hu.66-E | 1176 | TTCCTCCTTCCTTCTACTGCCTGCCTGCCTGCCTCCATCTCCTTCTTCCATCTCAAATGCGGAGAACGGGCAACTGGAGTTCAGC |
| rh.38-E | 1176 | TTCCTCCTTCCTTCTACTGCCTGCCTGCCTGCCTCCATCTCCTTCTTCCATCTCAAATGCTGAGAACGGGCAACTGGAAACAATTTGAATTCAGC |
| hu.32-F | 1173 | TTCGTCCTTTCTACTGCCTGCCTGCCTGCCTCCATCTCCCGTCGCAAATGCTAAGAACGGGTAACAACTTCCAGTTCAGC |
| AAV9/hu | 1173 | TTCGTCCTTTTACTGCCTGCCTGCCTGCCTCCCATCTCCCGCGCAAATGCTAAGAACGGTAACAACTTCCAGTTCAGC |
| hu.31-F | 1173 | TTCGTCCTTTTACTGCCTGCCTGCCTGCCTCCCATCTCCCGCGCAAATGCTAAGAACGGTAACAACTTCCAGTTCAGC |
| | | 1270      1280      1290      1300      1310      1320      1330 |
| | | ....|....|....|....|....|....|....|....|....|....|....|....|....| |
| AAV5 | 1216 | TACAACTTTGAGGAGGTGCCCTTCCACTCCAGCTTCGCTCCCAGTCAGCAGCAGCAGCAGCTTCAAGCTGGCCAACC |
| AAV3-3 | 1237 | TATACCTTCGAGGATGTACTTTCACAGCAGCTCACAGAGCTACAGCCAGAGTTTGGATCGCTTGATGAATC |
| AAV4-4 | 1219 | TACAGTTTTGAGAAGGTTGCCTTCCACTCGATGTACGCCACAGCAGCCAGAGCCTGGACCGGCTGATGAACC |
| AAV1-A | 1240 | TACACCTTTGAGGAAGTGCCTTTCCACAGCAGCTACGCTCATAGCCAGCCAGAGCCTGGACCGGCTGATGAATC |

| | | | |
|---|---|---|---|
| hu.20-B | 1444 | TGTTACCGCCAGCAGCGAGTATCAAAGACAGCTGCGGACAAC--------------------AACAACAGTGATT |
| hu.24-B | 1444 | TGTTACCGCCAGCAGCGAGTATCAAAGACAGCTGCGGACAAC--------------------AACAACAGTGATT |
| hu.64-B | 1444 | TGTTACCGCCAGCAGCGAGTATCAAAGACATCTGCGGATAAC--------------------AACAACAGTGAAT |
| hu.27-B | 1444 | TGTTACCGCCAGCAGCGAGTATCAAAGACAGCTGCGGACAAC--------------------AACAACAGTGATT |
| hu.21-B | 1444 | TGTTACCGCCAGCAGCGAGTATCAAAGACAGCTGCGGACAAC--------------------AACAACAGTGATT |
| hu.22-B | 1444 | TGTTACCGCCAGCAGCGAGTATCAAAGACAGCTGCGGACAAC--------------------AACAACAGTGATT |
| hu.23-B | 1444 | TGTTACCGCCAGCAGCGAGTATCAAAGACAGCTGCGGACAAC--------------------AACAACAGTGATT |
| hu.7-C | 1444 | TGCTACAGACAGCAGCGTCTGTCAAAGCAGGCAGGCAAACGACAAC--------------------AACAACAGCAACT |
| hu.61-C | 1444 | TGCTACAGACAGCAGCGTCTGTCAAAGCAGGCAGGCAAACGACAAC--------------------AACAACAGCAACT |
| rh.56-C | 1444 | TGCTACAGACAGCAGCGTCTGTCAAAGCAGGCAGGCAAACGACAAC--------------------AACAACAGCAACT |
| hu.9-C | 1444 | TGCTACAGACAGCAGCGTCTCTTCAAAGCAGGCAGGCAAACGACAAC--------------------AACAACAGCAACT |
| hu.54-C | 1441 | TGTTATCGCCAGCAGCGTTTGTCAAAGCAGGCAGGCAAACGACAAC--------------------AACAACAGCAACT |
| hu.53-C | 1441 | TGTTATCGCCAGCAGCGTTTGTCAAAGCAGGCAGGCAAACGACAAC--------------------AACAACAGCAACT |
| hu.60-C | 1444 | TGCTACAGACAGCAGCGTCTGTCAAAGCAGGCAGGCAAACGACAAC--------------------AACAACAGCAACT |
| hu.55-C | 1441 | TGTTATCGCCAGCAGCGTTTGTCAAACAGGCAGGCAAACGACAAC--------------------AACAACAGCAACT |
| hu.2-C | 1444 | TGCTACAGACAGCAGCGTCTGTCAAAGCAGGCAGGCAAACGACAAC--------------------AACAACAGCAACT |
| hu.1-C | 1444 | TGCTACAGACAGCAGCGTCTGTCAAAGCAGGCAGGCAAACGACAAC--------------------AACAACAGCAACT |
| hu.18-C | 1444 | TGCTACAGACAGCAGCGTCTGTCAAAGCAGGCAGGCAAACGGCAAC--------------------AACAACAGCAACT |
| hu.3-C | 1447 | TGCTACAGACAGCAGCGTCTGTCAAAGCAGGCAGGCAAACGACAAT--------------------AACAACTGCAACT |
| hu.25-C | 1444 | TGCTACAGACAGCAGCGTCTGTCAAAGCAGGCAGGCAAACGACAAC--------------------AACAACAGCAACT |
| hu.15-C | 1444 | TGCTACAGACAGCAGCGTCTGTCAAAGCAGGCAGGCAAACGACAAC--------------------AACAACAGCAACT |
| hu.16-C | 1444 | TGCTACAGACAGCAGCGTCTCTTCAAAGCAGGCAGGCAAACGACAAC--------------------AACAACAGCAACT |
| hu.11-C | 1444 | TGCTACAGACAGCAGCGTCTCTTCAAAGCAGGCAGGCAAACGACAAC--------------------AACAACAGCAACT |
| hu.10-C | 1444 | TGCTACAGACAGCAGCGTCTGTCAAAGCAGGCAGGCAAACGACAAC--------------------AACAACAGCAACT |
| hu.4-C | 1444 | TGCTACAGACAGCAGCGTCTGTCAAAACAGGCAGGCAAACAGCAAC--------------------AACAACAGCAACT |
| rh.54-D | 1453 | TGCTTCCGGCAACAAAGAGTTCCAAAACACTGCTCAAAAC----------------AACAACAGCAACT |
| rh.48-D | 1453 | TGCTTCCGGCAACAAAGAGTCTCCAAGACGCTGATCAAAAC----------------AACAACAGCAACT |
| hu.55-D | 1453 | TGCTTCCGGCAACAAAGAGTCTCCAAGACGCTGATCAAAAC----------------AACAACAGCAACT |
| rh.62-D | 1453 | TGCTTCCGGCAACAAAGAGTCTCCAAGACGCTGATCAAAAC----------------AACAACAGCAACT |
| AAV7-D | 1453 | TGCTTCCGGCAACAAAGAGTCTCCAAAACGCTGATCAAAAC----------------AACAACAGCAACT |

FIG. 3BH

```
rh.52-E   1453 TGCTACAGACAGCAGCGGCGTCTCCACGACACTGTCGCAAAAC------------------------AACAACAGCAACT
rh.51-E   1453 TGCTACAGACAGCAGCAGCGCGTCTCCACGACACTGTCGCAAAAC------------------------AACAACAGCAACT
hu.39-E   1453 TGCTACAGACAGCAGCAGCGCGTCTCCACGACACTGTCGCAAAAC------------------------AACAACAGCAACT
rh.53-E   1453 TGCTACAGACAGCAGCAGCGCGTCTCCACGACACTGTCGCAAAAC------------------------AACAACAGCAACT
hu.37-E   1453 TGCTACCGGCAGCAGCAGCGCGAGTCTCTAACGACACTGTCGCAAAAC------------------------AACAACAGCAACT
rh.43-E   1450 TGTTACCGCCAACAGCAGCGCGCGTCTCCACGACACAACGGGCAAAAC------------------------AACAATAGCAACT
hu.50-E   1453 TGCTACAGACAGCAGCAGCGCGCGTCTCCACGACACTGTCGCAAAAC------------------------AACAACAGCAACT
hu.49-E   1453 TGCTACAGACAGCAGCAGCGCGCGTCTCCACGACACTGTCGCAAAAC------------------------AACAACAGCAACT
rh.61-E   1453 TGCTACAGACAGCAGCAGCGCGCGTCTCCACGACACTGTCGCAAAAC------------------------AACAACAGCAACT
hu.41-E   1453 TGCTACCGGCAGCAGCAGCGCGAGTCTCTACGACACTGTCGCAAAAC------------------------AACAACAGCAACT
rh.64-E   1453 TGCTACAGACAGCAGCAGCGCGAGTCTCTACGACACTGTCGCAAAAC------------------------AACAACAGCAACT
hu.42-E   1453 TGCTACCGGCAGCAGCAGCGCGAGTCTCTACGACACTGTCGCAAAGC------------------------AACAACAGCAACT
rh.57-E   1453 TGCTACAGACAGCAGCAGCGCGCGTCTCCACGACACTGTCGCAAAAC------------------------AACAACAGCAACT
hu.40-E   1453 TGCTACCGGCAGCAGCAGCGCGCGTCTCCACGACACTGTCGCAAAAC------------------------AACAACAGCAACT
AAV8-E    1453 TGTTACCGCCAACAGCAGCGCGTCTCAACGACAACACTGTCGCAAAAC------------------------AACAATAGCAACT
rh.58-E   1453 TGCTACAGACAGCAGCAGCGCGAGTCTCCACGACACTGTCGCAAAAC------------------------AACAACAGCAACT
rh.40-E   1453 TGCTACCGGCAGCAGCAGCGCGAGTCTCTACGACACTGTCGCAAAAC------------------------AACAACAGCAACT
hu.67-E   1453 TGCTACCGGCAGCAGCAGCGCGAGTCTCTACGACACTGTCGCAAAAC------------------------AACAACAGCAACT
hu.17-E   1453 TGCTACCGGCAGCAGCAGCAACGCGTCTCCACGACACTGTCGCAAAAT------------------------AACAACAGCAACT
hu.6-E    1453 TGCTACCGGCAGCAGCAGCAACGCGTCTCCACGACACTGTCGCAAAAT------------------------AACAACAGCAACT
hu.66-E   1453 TGCTACCGGCAGCAGCAGCGCGAGTCTCTACGACACTGTCGCAAAAC------------------------AACAACAGCAACT
rh.38-E   1453 TGCTACCGGCAGCAGCAGCGTGTCTCTACCACTGTCGCAAAAC------------------------AACAACAGCAACT
hu.32-F   1447 AGCTACCGGACAACAACAACGTGTCTCAACCACTGTGACTCAAAAC------------------------AACAACAGCGAAT
AAV9/hu   1447 AGCTACCGGACAACAACAACGTGTCTCAACCACTGTGACTCAAAAC------------------------AACAACAGCGAAT
hu.31-F   1447 AGCTACCGGACAACAACAACGTGTCTCAACCACTGTGACTCAAAAC------------------------AACAACAGCGAAT
               ....|....|....|....|....|....|....|....|....|....|....|....|....|....|....|....|
                      1550      1560      1570      1580      1590      1600      1610

AAV5    1460 GCGCCTTCGCCACGACGGCCAATAGGATGGAGCTCGAGGGCGAGTTACCAGGTGCCCCGCAGCCGAACGG
AAV3-3_ 1502 TTCCTTGACAGCGGCCGGCCAGCAAATATCATCTCAATGCCCGACTCGCTGGTGAATCCAGGACCAGCTAT
```

```
AAV8-E    1578 GGCAACACACAAAGACGACGAGGAGCGTTTTTTCCCAGTAACGGGATCCTGATTTTTGGCAAACAAAAT
rh.58-E   1578 GGCAACCAACGCATAAGGACGACGAGGAGCGACCGCTTCTTCCCATCCTCCATCGACGGCATCGTTTGGCAAGCAGGGA
rh.40-E   1578 GGCAACGCACACCCACAAGGACGACGAGGAGCGAACGTTTCTTCTTTCCATCCTGAGTCCTGATGTTTGGAAAACAGGGT
hu.67-E   1578 GGCAACGCACACCCACAAGGACGACGAGGAGCGAACGCTTCTTCCCGTCGAGTGGAGTCCTGATGTTTGGAAACAGGGT
hu.17-E   1578 GGCAACGCACAAGGACGACGAGGAGCGAAGAGCGATTTTTTCCATCCAGCGAGTCTTGATGTTTGGGAAACAGGGA
hu.6-E    1578 GGCAACGCACAAGGACGACGAGGAGCGAAGAGCGATTTTTTCCATCCAGCGAGTCTTGATGTTTGGGAAACAGGGA
hu.66-E   1578 GGCAACCCACAAGGACGACGAGGAGCGAACGCTTCTTCCCGTCGAGTGGAGTCCTGATGTTTGGAAAACAGGGT
rh.38-E   1578 GGCAACCCACAAGGACGACGAGGAGCGAACGCTTCTTCCCGTCGAGTGGAGTCCTGATGTTTGGAAAACAGGGT
rh.32-F   1572 GGCCAGCCACACAAGGAGAGAGAGAGACCCGTTTCTTCCTTGTCTGATCTTTAATTTTTGGCAAACAAGGA
AAV9/hu   1572 GGCCAGCCACAAAGAAGGAGAGAGAGAGAGACCGTTTCTTCCTTGTCCGATCTTTAATTTTTGGCAAACAAGGA
hu.31-F   1572 GGCCAGCCACAAAGAAGGAGAGAGAGAGAGACCCGTTTCTTCCTTTGTCCGATCTTTAATTTTTGGCAAACAAGGA

....|....|....|....|....|....|....|....|....|....|....|....|....|....|....|
                        1690       1700       1710       1720       1730       1740       1750

AAV5      1600 GCGAACCCGGCACCACCGCCACCGCCACGTACCTCGAGGGCAACATGCTCATCACCAGCGAGAGCGAGCGCAGC
AAV3-3    1642 ACA------ACGGCAAGTAACGCAGAATTAGAT---AATGTAATGATTACGGATGAAGAGATTCGTA
AAV4-4    1636 AAC------GGCAACACGGCCACCTGGACCGTACCCGGG---ACTCTGATCTTCACCTCTGAGGAGGAGCTGGCAG
AAV1-A    1642 GCC------GGAGCTTCAAACACTGACTGGAC----AATGTCATGATTACAGACGAAGAAGAGAGAATTAAAG
hu.46-A   1642 GCC------GGAGCTTCAAACACTGCACTGGAC----AATGTCATGATTACAGACGAAGAAGAGAGAATTAAAG
hu.48-A   1642 GCC------GGAGCTTCAAACACTGCACTGGAC----AATGTCATGATTACAGACGAAGAAGAGAGAATTAAAG
hu.44-A   1642 GCC------GGAGCTTCAAACACTGCACTGGAC----AATGTCATGATTACAGACGAAGAAGAGAGAATTAAAG
hu.43-A   1645 GCC------GGAGCTTCAAACACTGCACTGGAC----AATGTCATGATTACAGACGAAGAAGAGAGAATTAAAG
AAV6-A    1642 GCC------GGAGCTTCAAACACTGCACTGGAC----AATGTCATGATCATCAGACGAAGAAGAGAGAAATCAAAG
hu.34-B   1639 TCA------GAGAAAACAAATGTGGACATTGAA----AAGGTCATGATTACAGACGAAGAAGAGAGAAATCAGGA
hu.47-B   1639 TCA------GAGAAAACAAATGTGGACATTGAA----AAGGTCATGATTACAGACGAAGAAGAGAGAAATCAGGA
hu.29-B   1639 CCA------GAGAAAACAAATGTGGATATTGAA----AAGGTCATGATTACAGACGAAGAAGAGAGAAATCAGGA
hu.63-B   1639 TCG------GGAAAAACTAATGTGGACATTGAA----AAGGTCATGATTACAGACGAAGAAGAGAGAAATCAGGA
hu.56-B   1639 TCA------GAGAAAACAAATGTGGACATTGAA----AAGGTCATGATTACAGACGAAGAAGAGAGAAATCAGGA
hu.45-B   1639 TCA------GAGAAAACAAATGTGGACATTGAA----AAGGTCATGATTACAGACGAAGAAGAGAGAAATCAGGA
hu.57-B   1636 TCA------GAGAAAACAAATGTGGACATTGAA----AAGGTCATGATTACAGACGAAGAAGAGAGAAATCAGGA
```

| | | |
|---|---|---|
| hu.22-B | 1770 | AGCTACCTCAGATGTCAACACACAAGGCGTTCTTCCAGGCATGGTCTGGCAGGACAGAGAGACGTGTACCTG |
| hu.23-B | 1770 | AGCTACCTCAGATGTCAACACACAAGGCGTTCTTCCAGGCATGGTCTGGCAGGACAGAGAGACGTGTACCTG |
| hu.7-C | 1770 | AACTACTGGAACTGTCAATCACCAAGGAGCGTTACCTGGCATGGTGTGGCAGGATCGAGAGACGTGTACCTG |
| hu.61-C | 1770 | AACTACTGGAACTGTCAATCACCAAGGAGCGTTACCTGGCATGGTGTGGCAGGATCGAGAGACGTGTACCTG |
| hu.56-C | 1770 | AACTACTGGAACTGTCAATCACCGAGGAGCGTTACCTGGCATGGTGTGGCAGGATCGAGAGACGTGTACCTG |
| rh.56-C | 1770 | AACTACAGAAAATGTCAATCACCAGGAGCGTTACCTGGTATGGTGTGGCAGGATCGAGAGACGTGTACCTG |
| hu.9-C | 1770 | AAGTACTGAAACTGTGAATCACCAAGGAGCATTACCTGGTATGGTGTGGCAGGATCGAGAGACGTGTACCTG |
| hu.54-C | 1767 | AAGTACTGAAACTGTCAATCACCAAGGAGCATTACCTGGTATGGTGTGGCAGGATCGAGAGACGTGTACCTG |
| hu.53-C | 1767 | AAGTACTGGAACTGTCAATCACCAAGGAGCGTTACCTGGTATGGTGTGGCAGGATCGAGAGACGTGTACCTG |
| hu.60-C | 1770 | AACTACTGGAACTGTCAATCACCAAGGAGCATTACCTGGTATGGTGTGGCAGGATCGAGAGACGTGTACCTG |
| hu.55-C | 1767 | AAGTACTGGAACTGTGAATCGCCAAGGAGCGTTACCTGGTATGGTGTGGCAGGATCGAGAGACGTGTACCTG |
| hu.2-C | 1770 | AACTACTGGAACTGTCAATCACCAAGGAGCGTTACCTGGTATGGTGTGGCAGGATCGAGAGACGTGTACCTG |
| hu.1-C | 1770 | AACTACTGGAACTGTCAATCACCAAGGAGCGTTACCTGGTATGGTGTGGCAGGATCGAGAGACGTGTACCTT |
| hu.18-C | 1770 | AACTACTGGAACTGTCAATCACCAAGGAGCGTTACCTGGTATGGTGTGGCAGGATCGAGATGTGTACCTG |
| hu.3-C | 1773 | AACTACAGGAACTGTCAATCACCAAGGAGCGTTACCTGGTATGGTGTGGCAGGATCGAGAGACGTGTACCTG |
| hu.25-C | 1770 | AACTACTGGAACTGTCAATCACCAAGGAGCGTTACCTGGTATGGTGTGGCAGGATCGAGAGACGTGTACCTG |
| hu.15-C | 1770 | AACTACTGGAACTGTCAATCACCAAGGAGCGTTACCTGGTATGGTGTGGCAGGATCGAGAGACGTGTACCTG |
| hu.16-C | 1770 | AACTACTGGAACTGTCAATCACCAAGGAGCGTTACCTGGTATGGTGTGGCAGGATCGAGAGACGTGTACCTG |
| hu.11-C | 1770 | AACTACAGAAAATGTCAATCACCAAGGAGCGTTACCTGGTATGGTGTGGCAGGATCGAGAGACGTGTACCTG |
| hu.10-C | 1770 | AACTACAGAAAATGTCAATCACCAAGGAGCGTTACCTGGTATGGTGTGGCAGGATCGAGAGACGTGTACCTG |
| hu.4-C | 1770 | AACTACTGGAACTGTCAATCACCAAGGAGCGTTACCTGGTATGGTGTGGCAGGATCGAGAGACGTGTACCTG |
| rh.54-D | 1776 | CCAGACACACAAGTTGTCAACAACAGCAGGAGCCTTACCTGGCATGGTCTGGCAGAACCGGACGGACGTACCTG |
| rh.48-D | 1776 | CCAGACACACAAGTTGTCAACAACAGCAGGAGCCTTACCTGGCATGGTCTGGCAGAACCGGACGGACGTACCTG |
| rh.55-D | 1776 | CCAGACACACAAGTTGTCAACAACAGCAGGAGCCTTACCTGGCATGGTCTGGCAGAACCGGACGGACGTACCTG |
| rh.62-D | 1776 | CCAGACACACAAGTTGTCAACAACAGCAGGAGCCTTACCTGGCATGGTCTGGCAGAACCGGACGGACGTACCTG |
| AAV7-D | 1776 | CCAGACACACAAGTCGTCAACAACAGCAGGAGCCTTACCTGGCATGGTCTGGCAGAACCGGACGGACGTACCTG |
| rh.52-E | 1779 | TATTGTGGGGCCCGTCAACAGCAGGAGCCTTACCTGGCATGGTCTGGCAGAACCGGAACCGGACGTACTTG |
| rh.51-E | 1779 | TATTGTGGGGCCCGTCAACAGCAGGAGCCTTACCTGGCATGGTCTGGCAGAACCGGAACCGGACGTACCTG |
| hu.39-E | 1779 | TACTGTGGGGCCCGTCAACAGCAGGAGCCTTACCTGGCATGGTCTGGCAGAACCGGAACCGGACGTACCTG |
| rh.53-E | 1779 | TATTGTGGGGCCCGTCAACAGCAGGAGCCTTACCTGGCATGGTCTGGCAGAACCGGAACCGGACGTACCTG |
| hu.37-E | 1779 | TATTGTGGGAAATGTCAACAGCCAAGAGCCTTACCTGGCATGGTCTGGCAGAACCGGAACCGAGACGTACCTG |

| | | |
|---|---|---|
| hu.43-A | 1846 | CAGGGTCCCCATTTGGGCCAAAATTCCTCACACAGATGGACACTTTCACCCGTCTCCTCTTATGGGCGCT |
| AAV6-A | 1843 | CAGGGTCCTATTTGGGCCAAAATTCCTCACACGGATGGACACTTTCACCCGTCTCCTCTCCATGGGCGCT |
| hu.34-B | 1840 | CAGGGGCCCATCTGGGCCAAAGATTCCACACGGACGGACACATTTCACCCCTCTCCCCTCATGGGCGGAT |
| hu.47-B | 1840 | CAGGGGCCCATCTGGGCCAAAGATTCCACACGGACGGACACATTTCACCCCTCTCCCCTCATGGGGTGAT |
| hu.29-B | 1840 | CAGGGGCCTATTTGGGCCAAAGATTCCACACGGACGGACACATTTCACCCCTCTCCCCTCATGGGCGGAT |
| hu.63-B | 1840 | CAGGGGCCCATCTGGGCCAAAGATTCCACACGGACGGACACATTTCACCCCTCTCCCCTCATGGGCGGAT |
| hu.56-B | 1840 | CAGGGGCCCATCTGGGCCAAAAATTCCACACGGACGGACACATTTCACCCCTCTCCCCTCATGGGCGGAT |
| hu.45-B | 1840 | CAGGGGCCCATCTGGGCCAAAGATTCCACACGGACGGACACATTTCACCCCTCTCCCCTCATGGGCGGAT |
| hu.57-B | 1837 | CAGGGGCCCATCTGGGCCAAAGATTCCACACGGACGGACACATTTCACCCCTCTCCCCTCATGGGCGGAT |
| hu.35-B | 1840 | CAGGGGCCCATCTGGGCCAAAGATTCCACACGGACGGACACATTTCACCCCTCTCCCCTCATGGGCGGAT |
| hu.58-B | 1840 | CAGGGGCCTATCTGGGCCAAAGATTCCGCACGGACGGACACATTTCACCCCTCTCCCCTCATGGGCGGAT |
| hu.28-B | 1840 | CAGGGGCCTACTGGGCCAAAGATTCCACACGGACGGACACATTTCACCCCTCTCCCCTCATGGGCGGAT |
| hu.51-B | 1840 | CAGGGGCCCATCTGGGCCAAAGATTCCACACGGACGGACACATTTCACCCCTCTCCCCTCGTGGGCGGAT |
| hu.19-B | 1840 | CAGGGGCCCATCTGGGCCAAAGATTCCACACGGACGGACACATTTCACCCCTCTCCCCTCATGGGCGGAT |
| hu.49-B | 1840 | CAGGGGCCTATCTGGGCCAAAGATTCCACACGGACGGACACATTTCACCCCTCTCCCCTCATGGGCGGAT |
| hu.52-B | 1840 | CAGGGGCCCATCTGGGCCAAAGATTCCACACGGACGGACACATTTCACCCCTCTCCCCTCATGGGCGGAT |
| hu.13-B | 1840 | CAGGGGCCCATCTGGGCCAAAGATTCCACACGGACGGACACATTTCACCCCTCTCCCCTCATGGGCGGAT |
| AAV2-B | 1840 | CAGGGGCCCATCTGGGCCAAAGATTCCACACGGACGGACACATTTCACCCCTCTCCCCTCATGGGCGGAT |
| hu.20-B | 1840 | CAGGGGCCCATCTGGGCCAAAGATTCCACACGGACGGACACATTTCACCCCTCTCCCCCATGGGCGGAT |
| hu.24-B | 1840 | CAGGGGCCCATCTGGGCCAAAGATTCCACACGGACGGACACATTTCACCCCTCTCCCCTCATGGGCGGAT |
| hu.64-B | 1840 | CAGGGGCCCATCTGGGCCAAAGATTCCACACGGACGGACACATTTCACCCCTCTCCCCTCATGGGCGGAT |
| hu.27-B | 1840 | CAGGGGCCCATCTGGGCCAAAGATTCCACACGGACGGACACATTTCACCCCTCTCCCCTCATGGGCGGAT |
| hu.21-B | 1840 | CAGGGGCCCATCTGGGCCAAAGATTCCACACGGACGGACACATTTCACCCCTCTCCCCTCATGGGCGGAT |
| hu.22-B | 1840 | CAGGGGCCCATCTGGGCCAAAGATTCCACACGGACGGACACATTTCACCCCTCTCCCCTCATGGGCGGAT |
| hu.23-B | 1840 | CGGGGGCCCATCTGGGCCAAAGATTCCACACGGACGGACACATTTCACCCCTCTCCCCTCATGGGCGGAT |
| hu.7-C | 1840 | CAGGGACCCATTTGGGCCAAAGATTCCTCACACCGATGGACACTTTCATCCTTCTCCTTCCACTGGTGGAGGTT |
| hu.61-C | 1840 | CAGGGACCCATTTGGGCCAAAGATTCCTCACACCGATGGACACTTTCATCTTCTCCACTGGTGGAGGTT |
| rh.56-C | 1840 | CAGGGACCCATTTGGGCCAAGATTCCTCACACCGATGGACACTTTCATCCTTCTCCACTGATGGAGGTT |
| hu.9-C | 1840 | CAGGACCCATTTGGGCCAAGATTCCTCACACCGATGGACACTTTCACCCTTCTCCACTGATGGAGGTT |
| hu.54-C | 1837 | CGGGGACCCATTTGGGCCAAGATTCCTCACGCCGATGGACACTTTCATCCTTCTCCACTGATGGAGGTT |

| | | |
|---|---|---|
| hu.63-B | 2190 | CCTGACTCGTAATCTGTAA- |
| hu.56-B | 2190 | CCTGACTCGTAATCTGTAA- |
| hu.45-B | 2190 | CCTGACTCGTAATCTGTAA- |
| hu.57-B | 2187 | CCTGACTCGTAATCTGTAA- |
| hu.35-B | 2190 | CCTGACTCGTAATCTGTAA- |
| hu.58-B | 2190 | CCTGACTCGTAATCTGTAA- |
| hu.28-B | 2190 | CCTGACTCGTAATCTGTAA- |
| hu.51-B | 2190 | CCTGACTCGTAATCTGTAA- |
| hu.19-B | 2190 | CCTGACTCGTAATCTGTAA- |
| hu.49-B | 2190 | CCTGACTCGTAATCTGTAA- |
| hu.52-B | 2190 | CCTGACTCGTAATTTGTAA- |
| hu.13-B | 2190 | CCTGACTCGTAATCTGTAA- |
| AAV2-B | 2190 | CCTGACTCGTAATCTGTAA- |
| hu.20-B | 2190 | CCTGACTCGTAATCTGTAA- |
| hu.24-B | 2190 | CCTGACTCGTAATCTGTAA- |
| hu.64-B | 2190 | CCTGACTCGTAATCTGTAA- |
| hu.27-B | 2190 | CCTGACTCGTAATCTGTAA- |
| hu.21-B | 2190 | CCTGACTCGTAATCTGTAA- |
| hu.22-B | 2190 | CCTGACTCGTAATCTGTAA- |
| hu.23-B | 2190 | CCTGACTCGTAATCTGTAA- |
| hu.7-C | 2190 | CCTGACTCGTAATCTGTAA- |
| hu.61-C | 2187 | CCTGACTCGTAATCTGTAA- |
| rh.56-C | 2190 | CCTGACTCGTAATCTGTAA- |
| hu.9-C | 2190 | CCTGACTCGTAATCTGTAA- |
| hu.54-C | 2190 | CCTGACTCGTAATCTGTAA- |
| hu.53-C | 2187 | CCTGACTCGTAATCTGTAA- |
| hu.60-C | 2190 | CCTGACTCGTAATCTGTAA- |
| hu.55-C | 2187 | CCTGACTCGTAATCTGTAA- |
| hu.2-C | 2190 | CCTGACTCGTAATCTGTAAT |
| hu.1-C | 2190 | CCTGACTCGTAATCTGTAA- |

FIG. 3CL

| | | |
|---|---|---|
| hu.18-C | 2190 | CCCGACTCGTAATCTGTAA- |
| hu.3-C | 2193 | CCTGACTCGTAATCTGTAA- |
| hu.25-C | 2190 | CCTGACTCGTAATCTGTAA- |
| hu.15-C | 2190 | CCTGACTCGTAATCTGTAA- |
| hu.16-C | 2190 | CCTGACTCGTAATCTGTAA- |
| hu.11-C | 2190 | CCTGACTCGTAATCTGTAA- |
| hu.10-C | 2190 | CCTGACTCGTAATCTGTAA- |
| hu.4-C | 2190 | CCTGACTCGTAATCTGTAA- |
| rh.54-D | 2196 | CCTCACCCGTAATCTGTAA- |
| rh.48-D | 2196 | CCTCACCCGTAATCTGTAA- |
| rh.55-D | 2196 | CCTCACCCGTAATCTGTAA- |
| rh.62-D | 2196 | CCTCACCCGTAATCTGTAA- |
| AAV7-D | 2196 | CCTCACCCGTAATCTGTAA- |
| rh.52-E | 2199 | CCTCACCCGTAATCTGTAA- |
| rh.51-E | 2199 | CCTCACCCGTAATCTGTAA- |
| hu.39-E | 2199 | CCCCACCCGTAATCTGTAA- |
| rh.53-E | 2199 | CCTCACCCGTAATCTGTAA- |
| hu.37-E | 2199 | CCTCACCCGTAATCTGTAA- |
| rh.43-E | 2193 | CCTCACCCGTAATCTGTAA- |
| rh.50-E | 2199 | CCTCACCCGTAATCTGTAA- |
| rh.49-E | 2199 | CCTCACCCGTAATCTGTAA- |
| rh.61-E | 2199 | CCTCACCCGTAATCTGTAA- |
| hu.41-E | 2199 | CCTCACCCGTAATCTGTAA- |
| rh.64-E | 2199 | CCTCACCCGTAATCTGTAA- |
| hu.42-E | 2199 | CCTCACCCGTAATCTGTAA- |
| rh.57-E | 2199 | CCTCACCCGTAATCTGTAA- |
| hu.40-E | 2199 | CCTCACCCGTAATCTGTAA- |
| AAV8-E | 2199 | CCTCACCCGTAATCTGTAA- |
| rh.58-E | 2199 | CCTCACCCGTAATCTGTAA- |
| rh.40-E | 2199 | TCTGACACGTAATCTGTAA- |

FIG. 3CM

| | | |
|---|---|---|
| hu.67-E | 2199 | CCTCACCCCGTAATCTGTAA- |
| hu.17-E | 2199 | CCTGACTCGTAATCTGTAA- |
| hu.6-E | 2199 | CCTCACCCGTAACCTGTAA- |
| hu.66-E | 2199 | CCTCACCCCGTAATCTGTAA- |
| rh.38-E | 2199 | CCTCACCCCGTAATCTGTAA- |
| hu.32-F | 2193 | CCTGACTCGTAATCTGTAA- |
| AAV9/hu | 2193 | CCTGACTCGTAATCTGTAA- |
| hu.31-F | 2193 | CCTGACTCGTAATCTGTAA- |

FIG. 3CN

In Vitro

Liver

Lung

Muscle

ADENO-ASSOCIATED VIRUS (AAV) CLADES, SEQUENCES, VECTORS CONTAINING SAME, AND USES THEREFOR

CROSS-REFERENCE TO RELATED APPLICATIONS

This is a national stage application under 35 U.S.C. 371 of PCT/US04/028817, filed Sep. 30, 2004, which claims the benefit under 35 U.S.C. 119(e) of the priority of U.S. Patent Application No. 60/508,226, filed Sep. 30, 2003 and U.S. Patent Application No. 60/566,546, filed Apr. 29, 2004.

STATEMENT REGARDING FEDERALLY SPONSORED RESEARCH OR DEVELOPMENT

This application contains work supported by grants NIDDK P30 DK47757 and NHLBI P01 HL59407 from the National Institutes of Health (NIH). The US government may have certain rights in this invention.

BACKGROUND OF THE INVENTION

Adeno-associated virus (AAV), a member of the Parvovirus family, is a small nonenveloped, icosahedral virus with single-stranded linear DNA genomes of 4.7 kilobases (kb) to 6 kb. AAV is assigned to the genus, *Dependovirus*, because the virus was discovered as a contaminant in purified adenovirus stocks. AAV's life cycle includes a latent phase at which AAV genomes, after infection, are site specifically integrated into host chromosomes and an infectious phase in which, following either adenovirus or herpes simplex virus infection, the integrated genomes are subsequently rescued, replicated, and packaged into infectious viruses. The properties of non-pathogenicity, broad host range of infectivity, including non-dividing cells, and potential site-specific chromosomal integration make AAV an attractive tool for gene transfer.

Recent studies suggest that AAV vectors may be the preferred vehicle for gene delivery. To date, there have been several different well-characterized AAVs isolated from human or non-human primates (NHP).

It has been found that AAVs of different serotypes exhibit different transfection efficiencies, and also exhibit tropism for different cells or tissues. However, the relationship between these different serotypes has not previously been explored.

What is desirable are AAV-based constructs for delivery of heterologous molecules.

SUMMARY OF THE INVENTION

The present invention provides "superfamilies" or "clades" of AAV of phylogenetically related sequences. These AAV clades provide a source of AAV sequences useful for targeting and/or delivering molecules to desired target cells or tissues.

In one aspect, the invention provides an AAV lade having at least three AAV members which are phylogenetically related as determined using a Neighbor-Joining heuristic by a bootstrap value of at least 75% (based on at least 1000 replicates) and a Poisson correction distance measurement of no more than 0.05, based on alignment of the AAV vp1 amino acid sequence. Suitably, the AAV lade is composed of AAV sequences useful in generating vectors.

The present invention further provides a human AAV serotype previously unknown, designated herein as clone 28.4/hu.14, or alternatively, AAV serotype 9. Thus, in another aspect, the invention provides an AAV of serotype 9 composed of AAV capsid which is serologically related to a capsid of the sequence of amino acids 1 to 736 of SEQ ID NO: 123 and serologically distinct from a capsid protein of any of AAV1, AAV2, AAV3, AAV4, AAV5, AAV6, AAV7 or AAV8.

Vectors constructed with capsid of this huAAV9 have exhibited gene transfer efficacies similar to AAV8 in liver, superior to AAV1 in muscle and 200 fold higher than AAV 5 in lung. Further, this novel human AAV serotype shares less than 85% sequence identity to previously described AAV1 through AAV8 and is not cross-neutralized by any of these AAVs.

The present invention also provides other novel AAV sequences, compositions containing these sequences, and uses therefor. Advantageously, these compositions are particularly well suited for use in compositions requiring re-administration of AAV vectors for therapeutic or prophylactic purposes.

These and other aspects of the invention will be readily apparent from the following detailed description of the invention.

BRIEF DESCRIPTION OF THE DRAWINGS

FIGS. 2A-2AE are an alignment of the amino acid sequences of AAV vp1 capsid proteins of the invention, with the numbering of the individual sequences reported, and previously published AAV1 [SEQ ID NO: 219]; AAV2 [SEQ ID NO: 221]; AAV3-3 [SEQ ID NO: 217]; AAV4-4 [SEQ ID NO: 218]; AAV5 [SEQ ID NO: 216]; AAV6 [SEQ ID NO: 220]; AAV7 [SEQ ID NO: 222]; AAV8 [SEQ ID NO: 223], and; rh. 25/42-15; 29.3/bb.1; cy.2; 29.5/bb.2; rh.32, rh.33, rh.34, rh.10; rh.24; rh14, rh.16, rh.17, rh.12, rh.18, rh.21 (formerly termed 41.10); rh.25 (formerly termed 41.15); rh2; rh.31; cy.3; cy.5; rh.13; cy.4; cy.6; rh.22; rh.19; rh.35; rh.37; rh.36; rh.23; rh.8; and ch.5 [U.S. Published Patent Application No. 2003/0138772 A1 (Jul. 24, 2003)]. The sequences of the invention include hu.14/AAV9 [SEQ ID NO:123]; hu.17 [SEQ ID NO: 83 ], hu. 6 [SEQ ID NO: 84 ], hu.42 [SEQ ID NO: 85], rh.38 [SEQ ID NO: 86], hu.40 [SEQ ID NO: 87], hu.37 [SEQ ID NO: 88 ], rh.40 [SEQ ID NO: 92], rh.52 [SEQ ID NO: 96]; rh.53 [SEQ ID NO: 97]; rh.49 [SEQ ID NO: 103]; rh.51 [SEQ ID NO: 104]; rh.57 [SEQ ID NO: 105 ]; rh.58 [SEQ ID NO: 106 ], rh.61 [SEQ ID NO: 107]; rh.50 [SEQ ID NO: 108 ]; rh.43 [SEQ ID NO: 163]; rh.62 [SEQ ID NO: 114 ]; rh.48 [SEQ ID NO: 115]; 4-9/rh.54 (SEQ ID No: 116); and 4-19/rh.55 (SEQ ID Nos: 117); hu.31 [SEQ ID NO: 121]; hu.32 [SEQ ID NO: 122]; hu.34 [SEQ ID NO: 125]; hu.45 [SEQ ID NO: 127]; hu.47 [SEQ ID NO: 128]; hu.13 [SEQ ID NO:129]; hu.28 [SEQ ID NO: 130]; hu.29 [SEQ ID NO:132]; hu.19 [SEQ ID NO: 133]; hu.20 [SEQ ID NO: 134]; hu.21 [SEQ ID NO: 135]; hu.23.2 [SEQ ID NO: 137]; hu.22 [SEQ ID NO: 138]; hu.27 [SEQ ID NO: 140]; hu.4 [SEQ ID NO: 141]; hu.2 [SEQ ID NO: 143]; hu.1 [SEQ ID NO: 144]; hu.3 [SEQ ID NO: 145]; hu.25 [SEQ ID NO: 146]; hu.15 [SEQ ID NO: 147]; hu.16 [SEQ ID NO: 148]; hu.18 [SEQ ID NO: 149]; hu.7 [SEQ ID NO: 150]; hu.11 [SEQ ID NO: 153]; hu.9 [SEQ ID NO: 155]; hu.10 [SEQ ID NO: 156]; hu.48 [SEQ ID NO: 157]; hu.44 [SEQ ID NO: 158]; hu.46 [SEQ ID NO: 159]; hu.43 [SEQ ID NO: 160]; hu.35 [SEQ ID NO: 164]; hu.24 [SEQ ID NO: 136]; rh.64 [SEQ ID NO: 99]; hu.41 [SEQ ID NO: 91]; hu.39 [SEQ ID NO: 102]; hu.67 [SEQ ID NO: 198]; hu.66 [SEQ ID NO: 197]; hu.51 [SEQ ID NO: 190]; hu.52 [SEQ ID NO: 191]; hu.49 [SEQ ID NO: 189]; hu.56 [SEQ ID NO: 192]; hu.57 [SEQ ID NO: 193]; hu.58 [SEQ ID NO: 194]; hu.63 [SEQ ID NO: 195]; hu.64 [SEQ ID NO: 196]; hu.60 [SEQ ID NO: 184]; hu.61 [SEQ ID NO: 185]; hu.53 [SEQ ID NO: 186]; hu.55 [SEQ ID NO: 187]; hu.54 [SEQ ID NO: 188]; hu.6 [SEQ ID NO: 84]; and rh.56 [SEQ ID NO: 152]. These capsid sequences are also reproduced in the Sequence Listing, which is incorporated by reference herein.

Figure 3A:
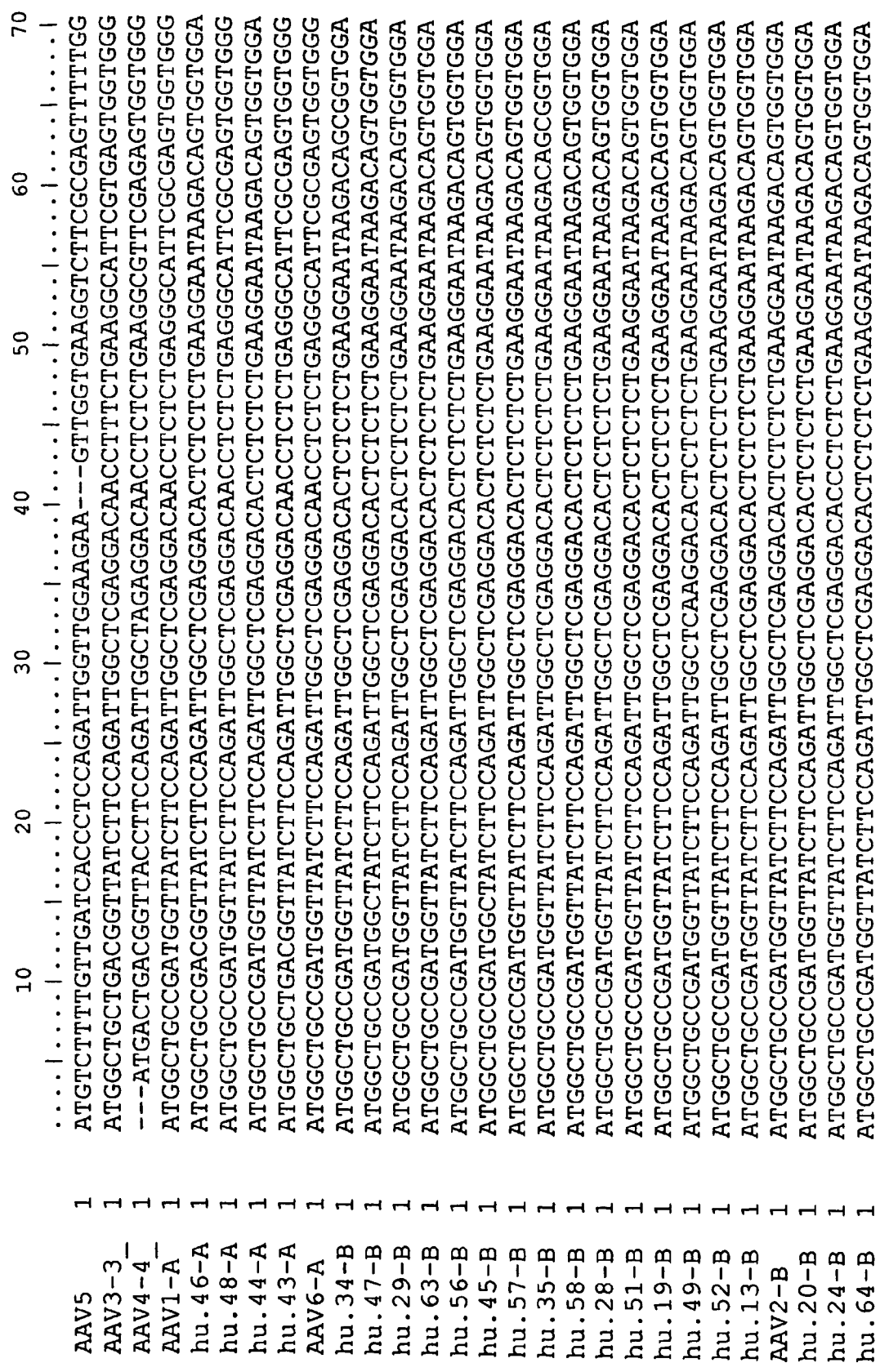
Figure 3B:
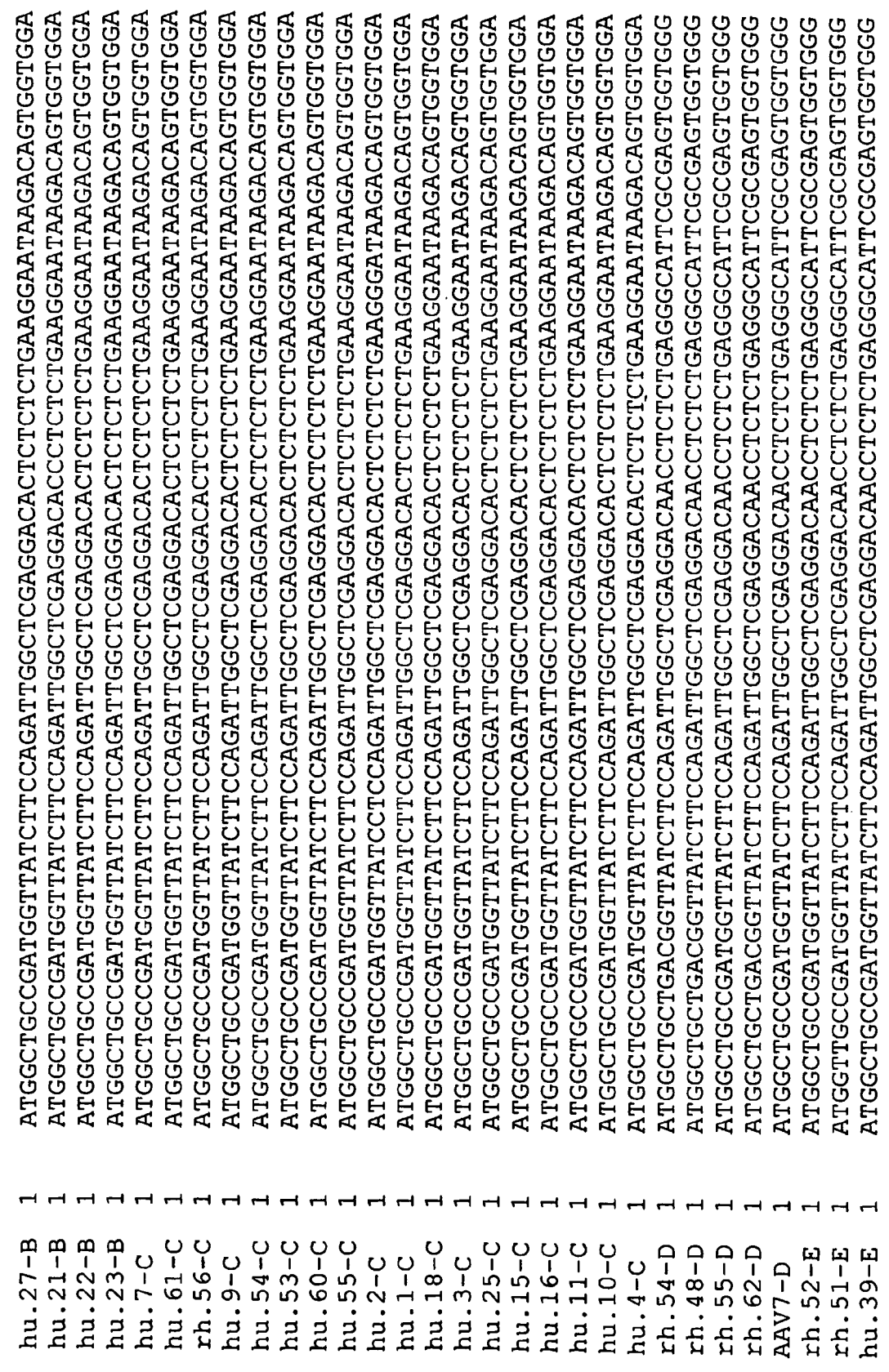
Figure 3C:
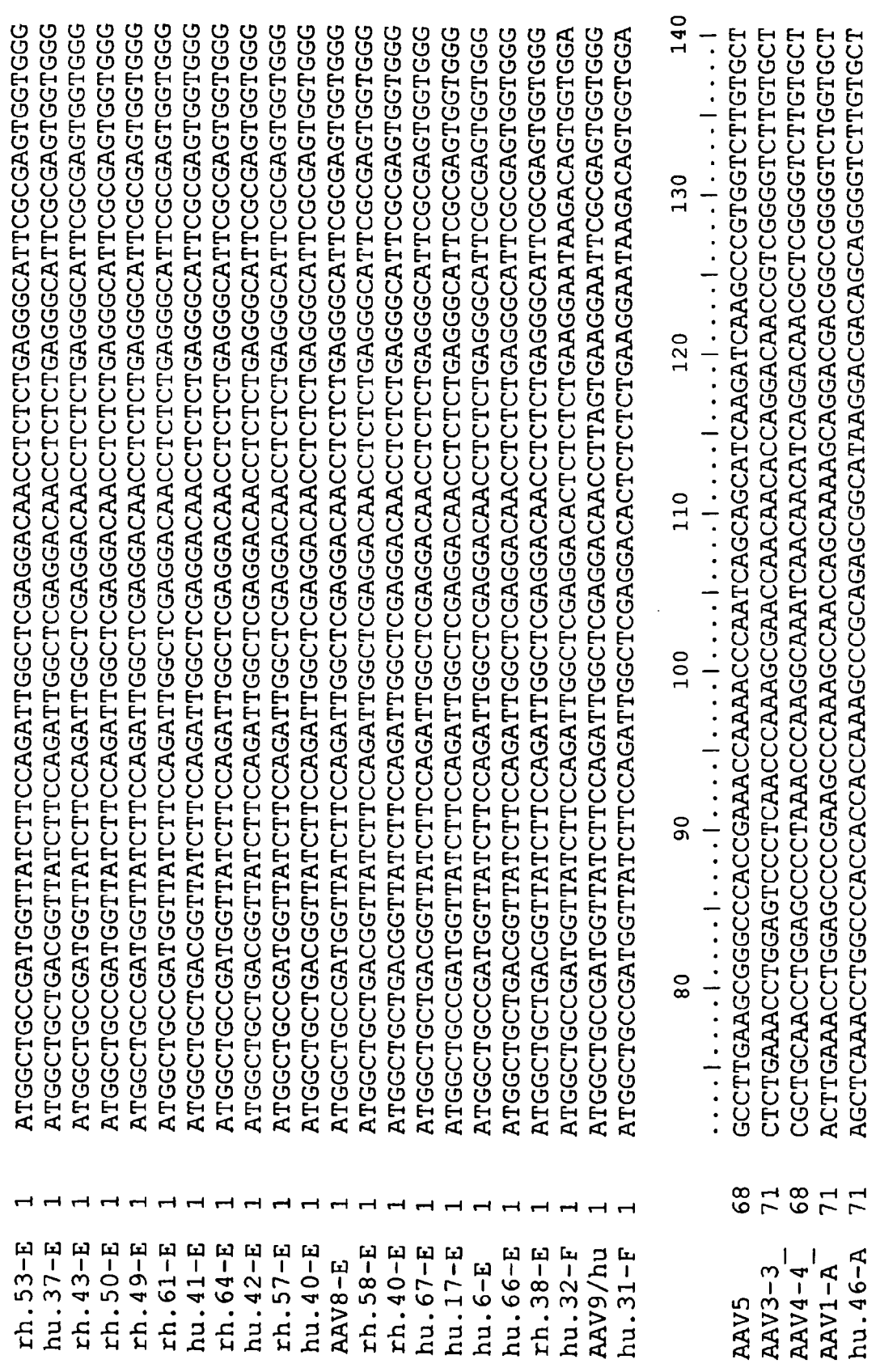
Figure 3D:
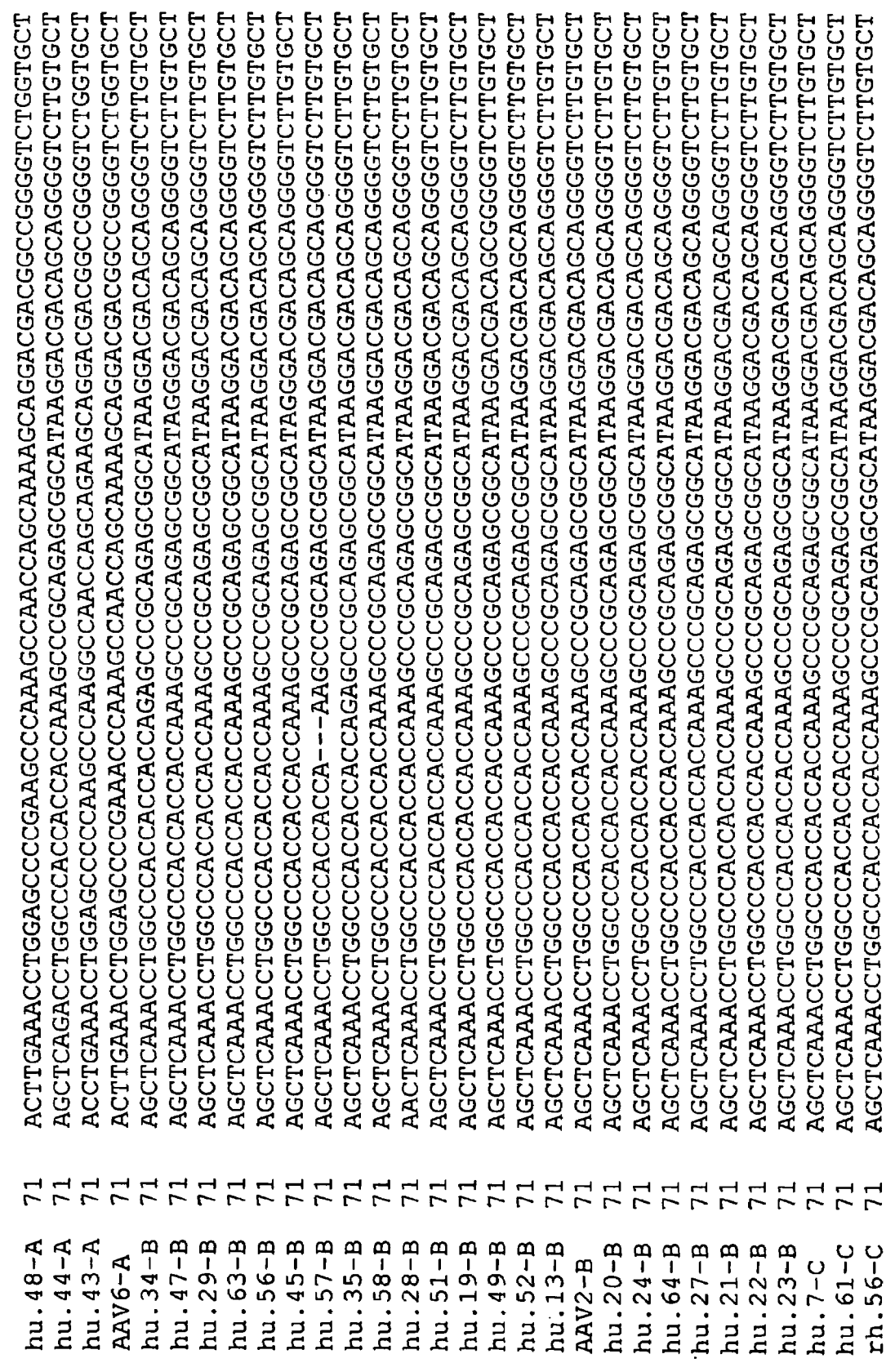
Figure 3E:
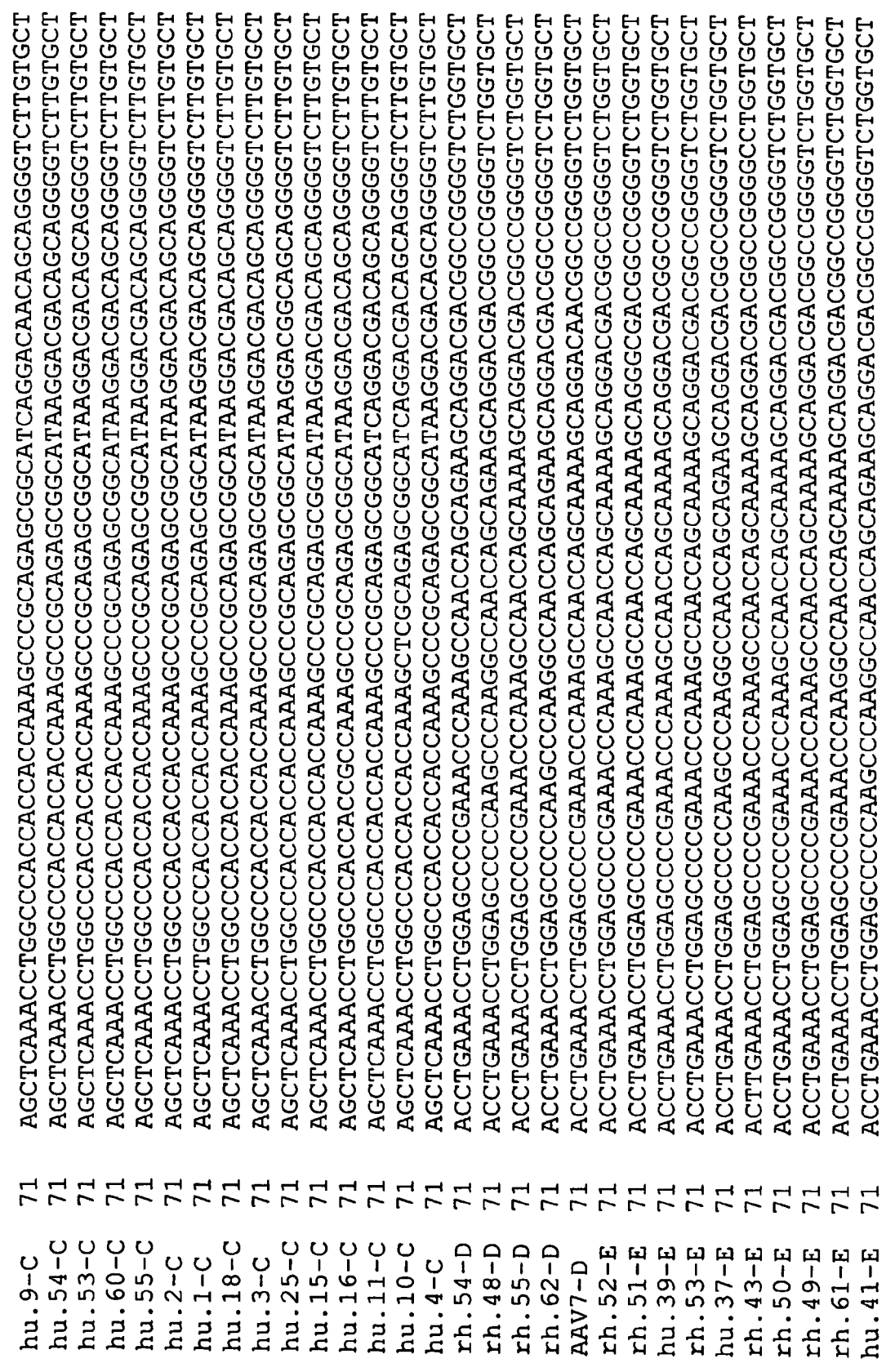
Figure 3H:
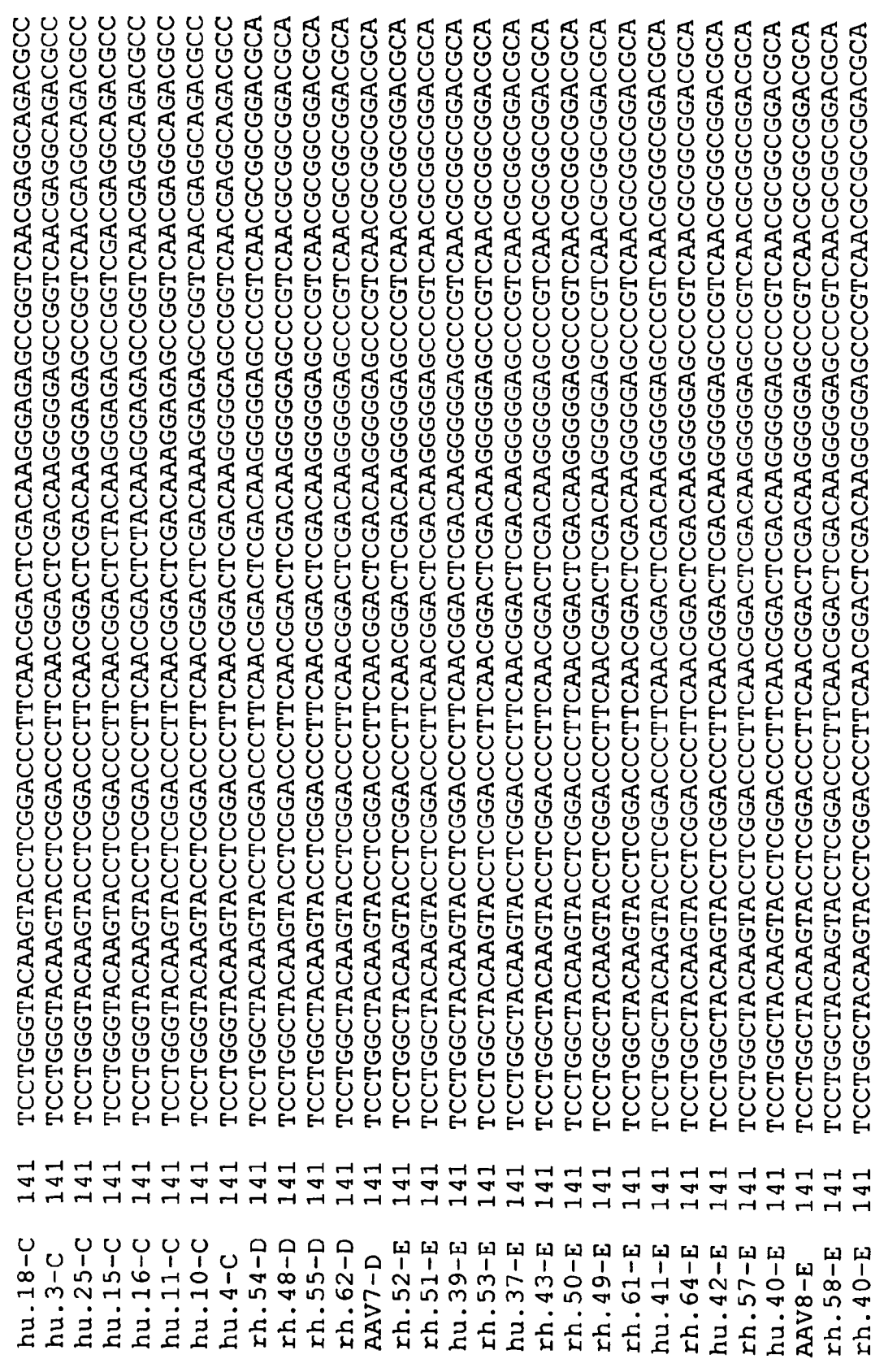
Figure 3I:
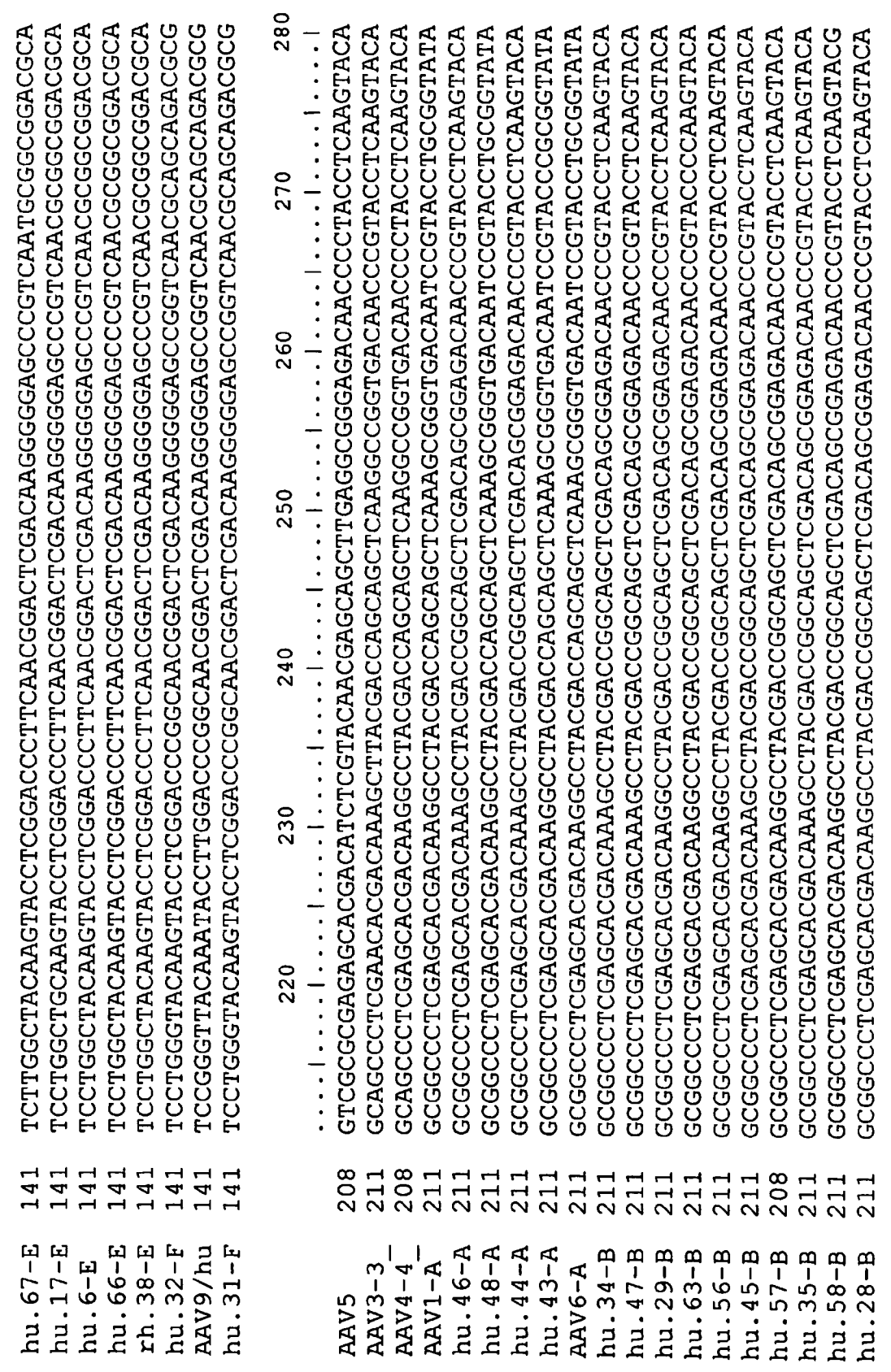
Figure 3J:
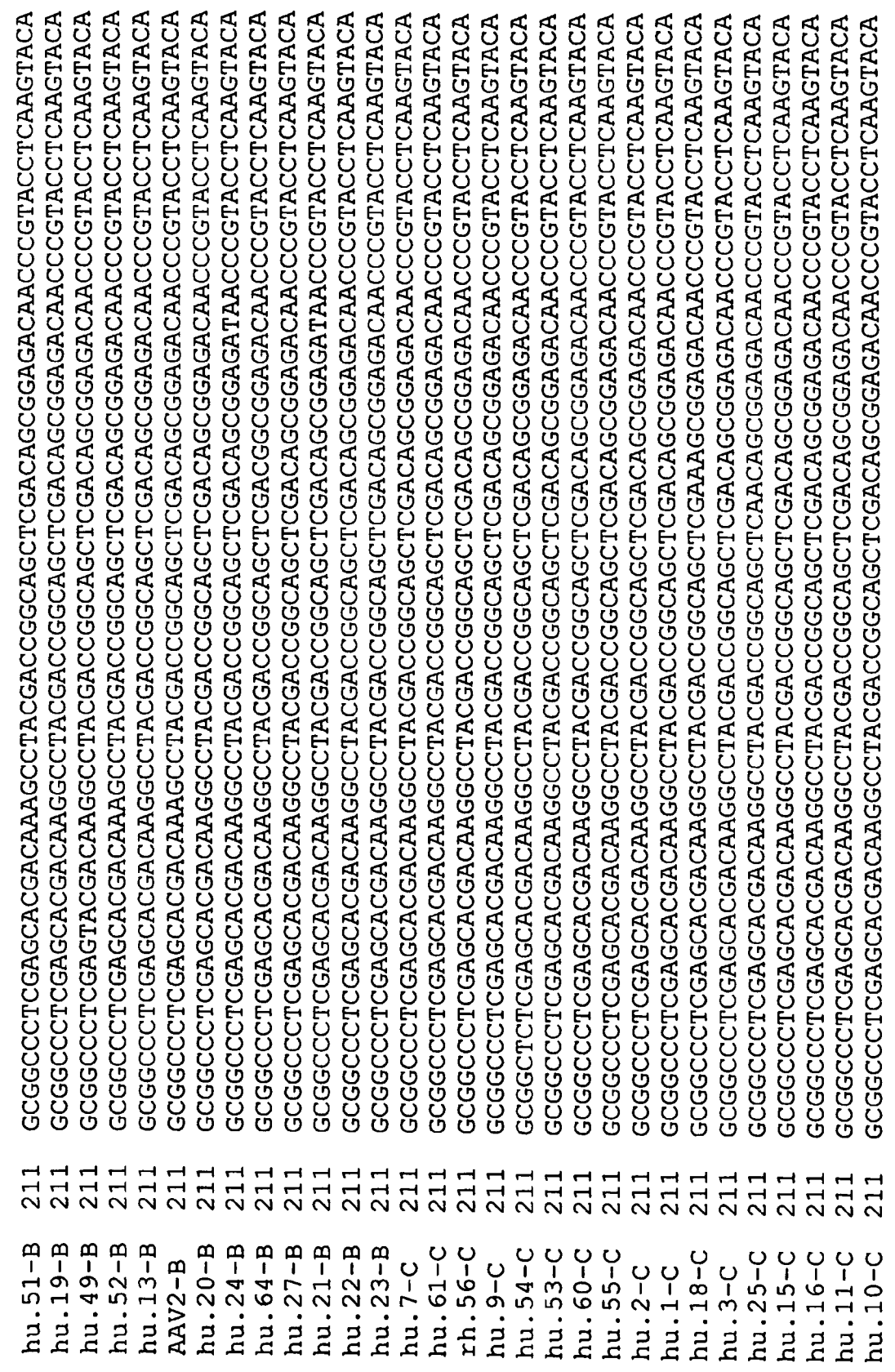
Figure 3K:
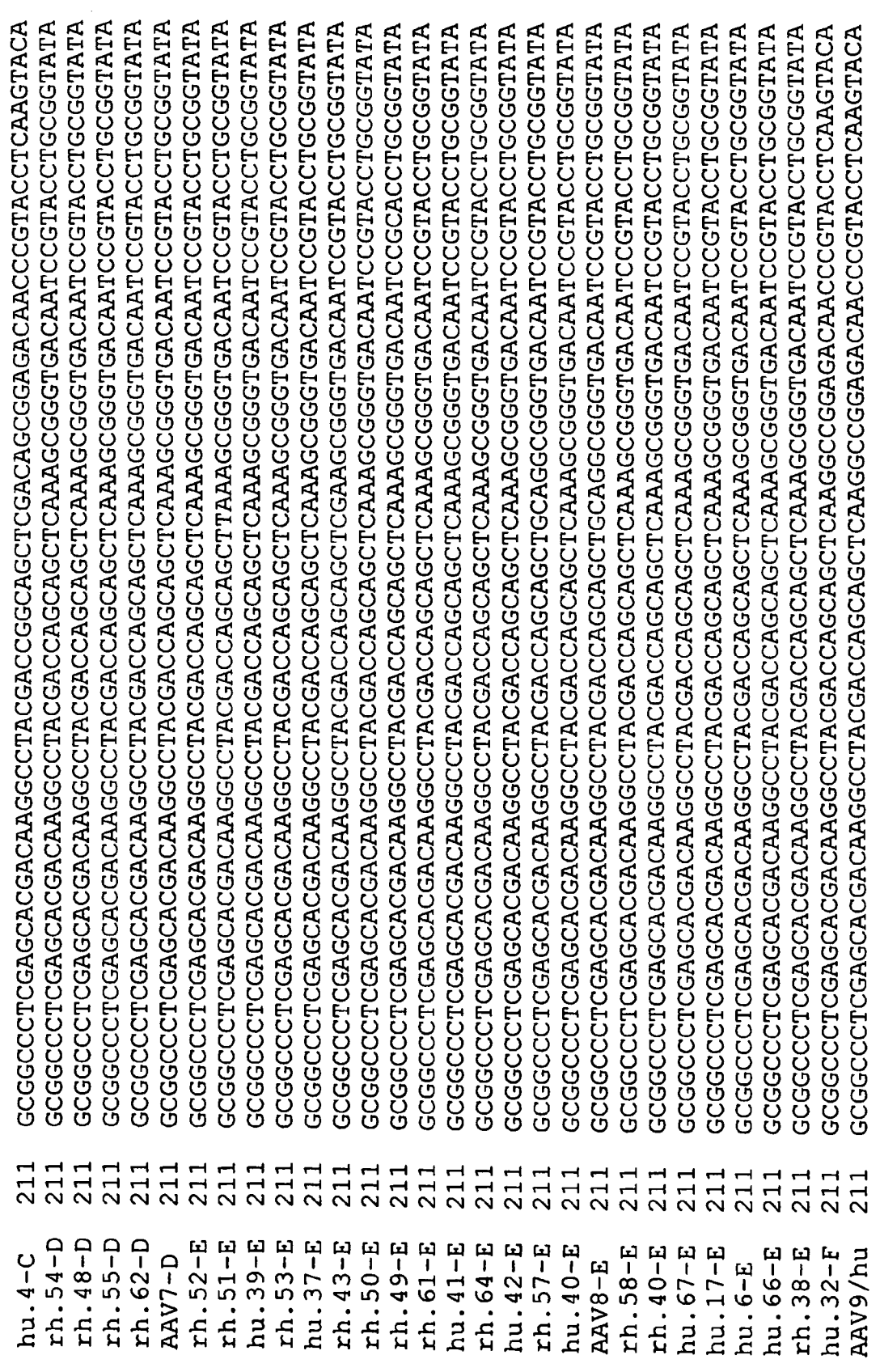
Figure 3L:
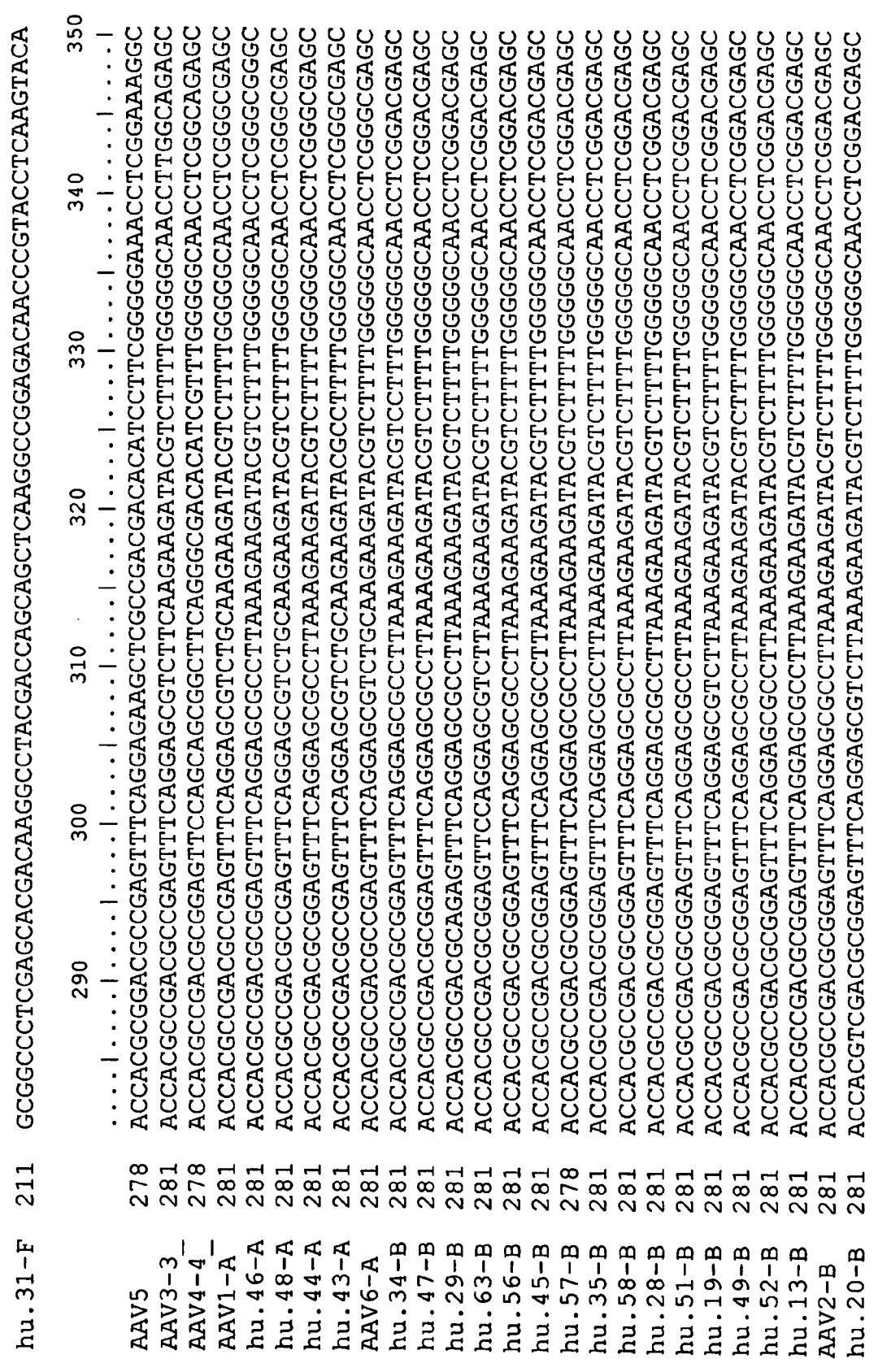
Figure 3N:
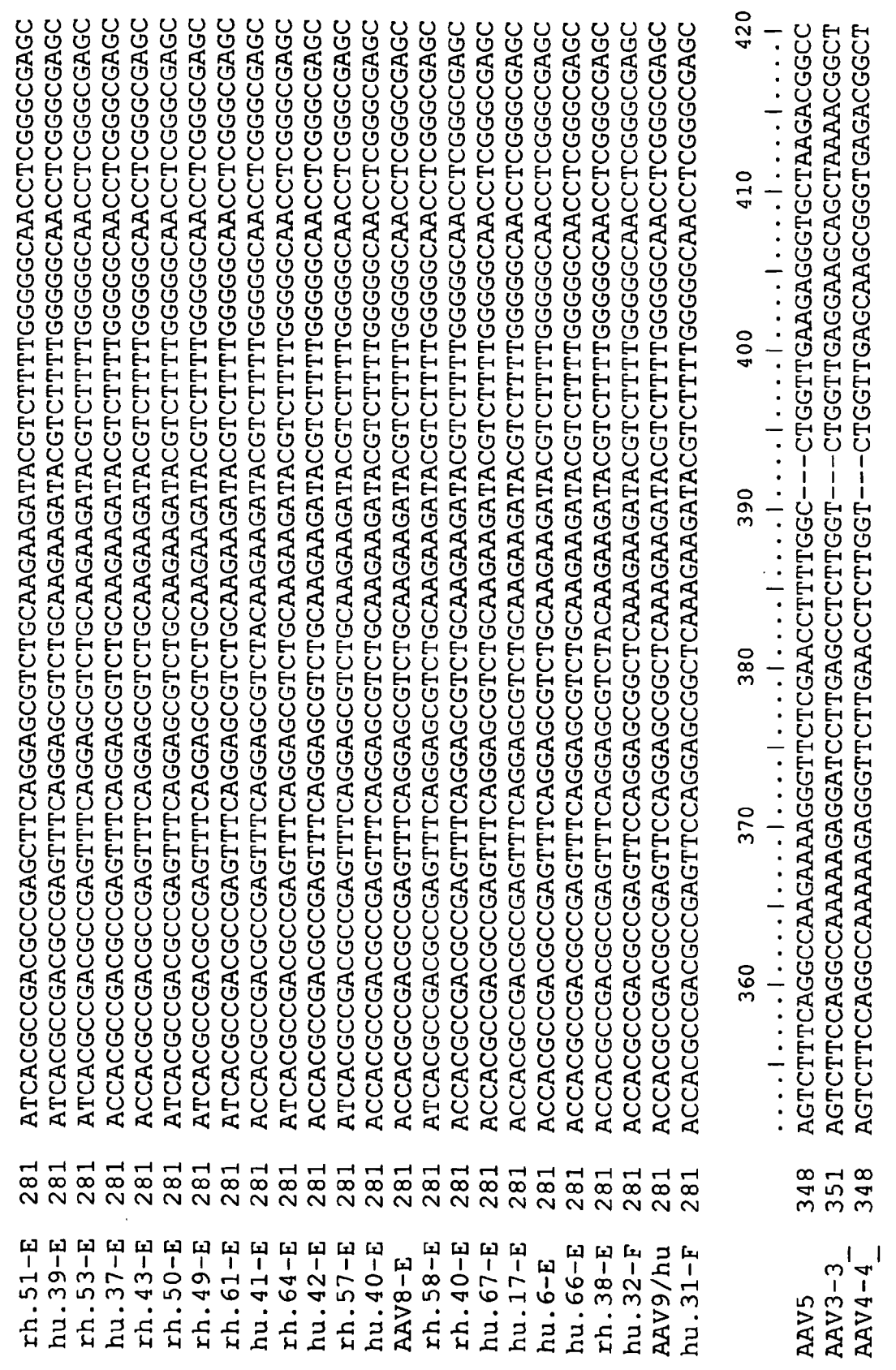
Figure 3S:
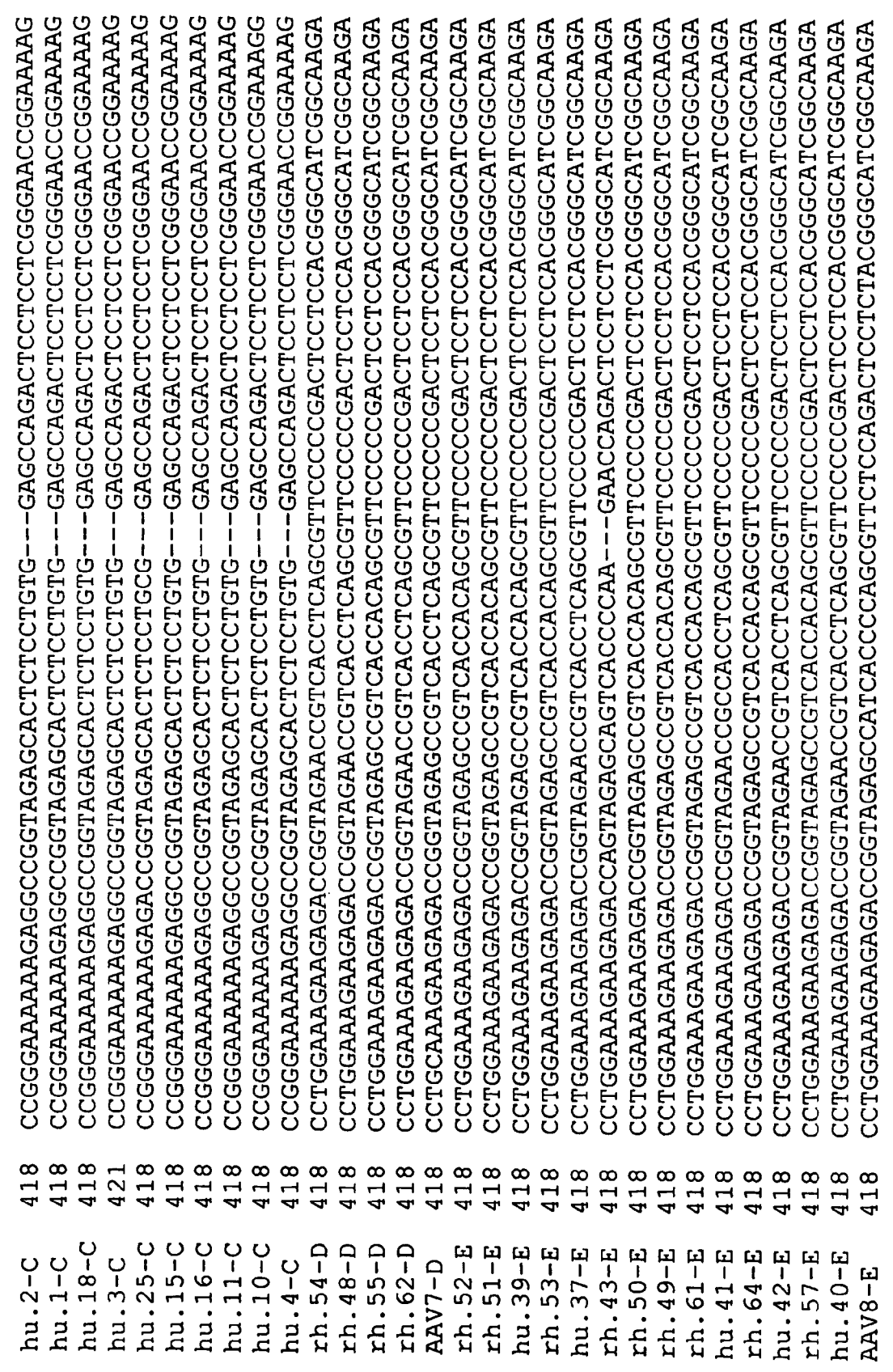
Figure 3X:
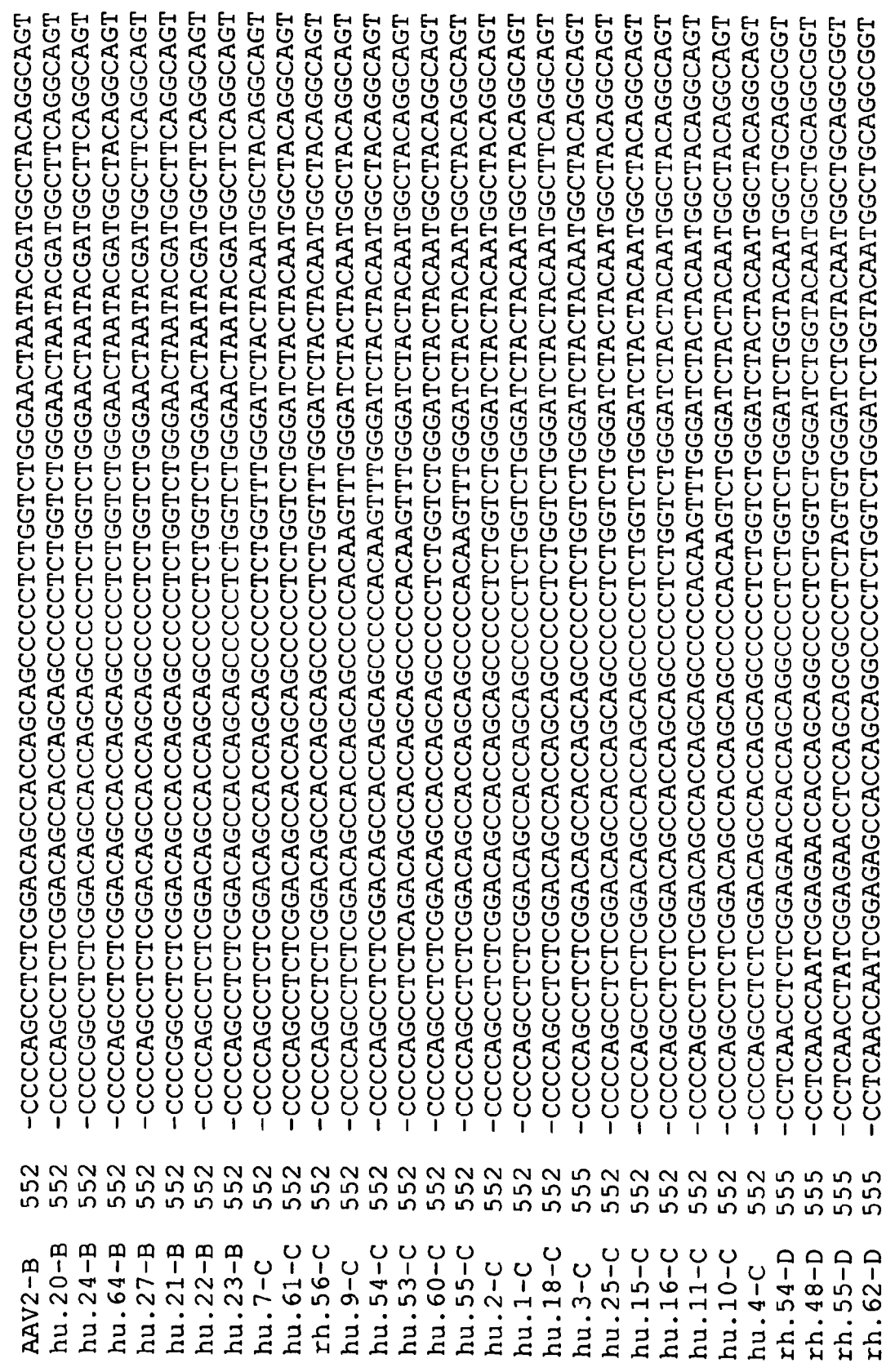
Figure 3Y:
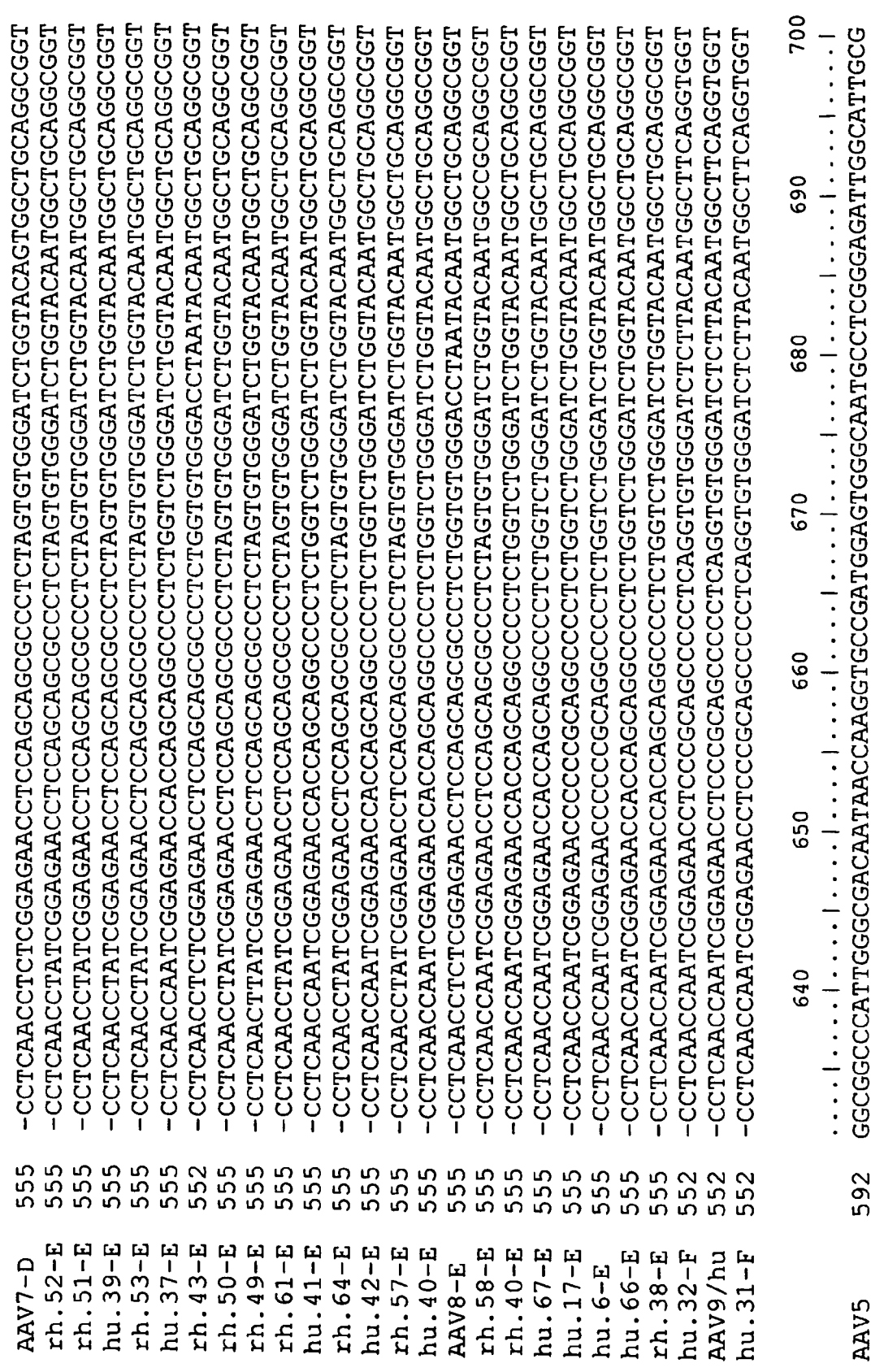
Figure 3Z:
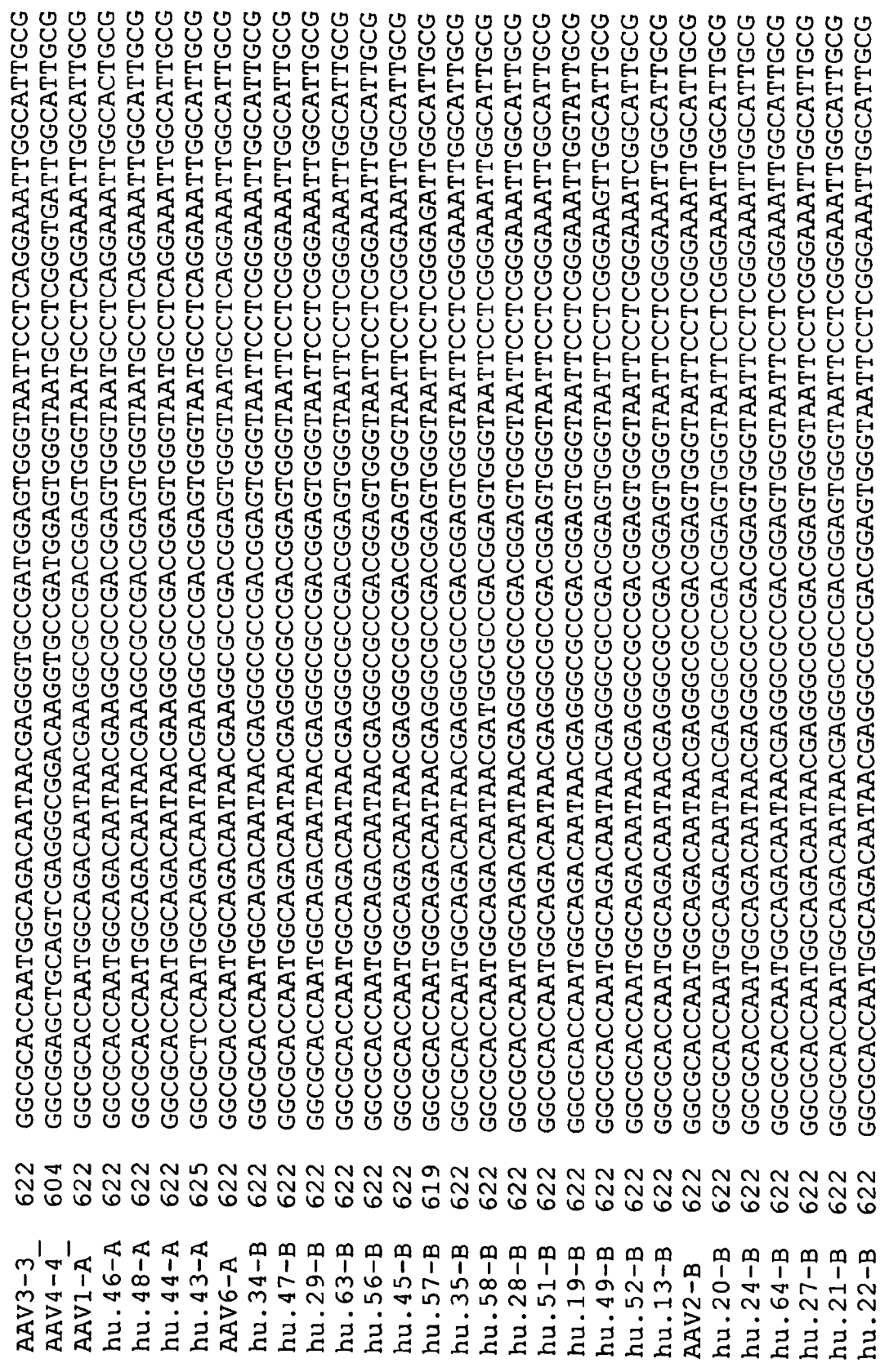

FIGS. 3A-3CN are an alignment of the nucleic acid sequences of AAV vp1 capsid proteins of the invention, with the numbering of the individual sequences reported, and previously published AAV5 (SEQ ID NO: 199); AAV3-3 (SEQ ID NO: 200): AAV4-4 (SEQ ID NO: 201); AAV1 (SEQ ID NO: 202); AAV6 (SEQ ID NO: 203); AAV2(SEQ ID NO: 211); AAV7 (SEQ ID NO: 213) and AAV8 (SEQ ID NO: 214); rh. 25/42-15; 29.3/bb.1; cy.2; 29.5/bb.2; rh.32, rh.33, rh.34, rh.10; rh.24; rh14, rh.16, rh.17, rh.12, rh.18, rh.21 (formerly termed 41.10); rh.25 (formerly termed 41.15; GenBank accession AY530557); rh2; rh.31; cy.3; cy.5; rh.13; cy.4: cy.6; rh.22, rh.19: rh.35, rh.37, rh.36; rh.23; rh.8; and ch.5 [U.S. Published Patent Application No. 2003/0138772 A1 (Jul. 24, 2003)]. The nucleic acid sequences of the invention include, hu.14/AAV9 (SEQ ID No: 3); LG-4/rh.38 (SEQ ID No: 7); LG-10/rh.40 (SEQ ID No: 14); N721-8/rh.43 (SEQ ID No: 43); 1-8/rh.49 (SEQ ID NO: 25); 2-4/rh.50 (SEQ ID No: 23); 2-5/rh.51 (SEQ ID No: 22); 3-9/rh.52 (SEQ ID No: 18); 3-11/rh.53 (SEQ ID NO: 17); 5-3/rh.57 (SEQ ID No: 26); 5-22/rh.58 (SEQ ID No: 27); 2-3/rh.61 (SEQ ID NO: 21); 4-8/rh.64 (SEQ ID No: 15); 3.1/hu.6 (SEQ ID NO: 5); 33.12/hu.17 (SEQ ID NO:4); 106.1/hu.37 (SEQ ID No: 10); LG-9/hu.39 (SEQ ID No: 24); 114.3/hu.40 (SEQ ID No: 11); 127.2/hu.41 (SEQ ID NO:6); 127.5/hu.42 (SEQ ID No: 8); and hu.66 (SEQ ID NO: 173 ); 2-15/rh.62 (SEQ ID NO: 33); 1-7/rh.48 (SEQ ID NO: 32); 4-9/rh.54 (SEQ ID No: 40); 4-19/rh.55 SEQ ID NO: 37); 52/hu.19 (SEQ ID NO: 62), 52.1/hu.20 (SEQ ID NO: 63), 54.5/hu.23 (SEQ ID No: 60), 54.2/hu.22 (SEQ ID No: 67), 54.7/hu.24 (SEQ ID No: 66), 54.1 /hu.21 (SEQ ID No: 65), 54.4R/hu.27 (SEQ ID No: 64); 46.2/hu.28 (SEQ ID No: 68); 46.6/hu.29 (SEQ ID No: 69); 128.1/hu.43 (SEQ ID No: 80); 128.3/hu.44 (SEQ ID No: 81) and 130.4/hu.48 (SEQ ID NO: 78); 3.1/hu.9 (SEQ ID No: 58); 16.8/hu.10(SEQ ID No: 56); 16.12/hu.11 (SEQ ID No: 57); 145.1 /hu.53 (SEQ ID No: 176); 145.6/hu.55 (SEQ ID No: 178); 145.5/hu.54 (SEQ ID No: 177); 7.3/hu.7 (SEQ ID No: 55); 52/hu.19 (SEQ ID No: 62); 33.4/hu.15 (SEQ ID No: 50); 33.8/hu.16 (SEQ ID No: 51): 58.2/hu.25 (SEQ ID No: 49); 161.10/hu.60 (SEQ ID No: 170); H-5/hu.3 (SEQ ID No: 44); H-1/hu.1 (SEQ ID No: 46); 161.6/hu.61 (SEQ ID No: 174); hu.31 (SEQ ID No: 1); hu.32 (SEQ ID No: 2); hu.46 (SEQ ID NO: 82); hu.34 (SEQ ID NO: 72); hu.47 (SEQ ID NO: 77); hu.63 (SEQ ID NO: 204); hu.56 (SEQ ID NO: 205); hu.45 (SEQ ID NO: 76); hu.57 (SEQ ID NO: 206); hu.35 (SEQ ID NO: 73); hu.58 (SEQ ID NO: 207); hu.51 (SEQ ID NO: 208): hu.49 (SEQ ID NO: 209); hu.52 (SEQ ID NO: 210); hu.13 (SEQ ID NO: 71); hu.64 (SEQ ID NO: 212); rh.56 (SEQ ID NO: 54); hu.2 (SEQ ID NO: 48); hu.18 (SEQ ID NO: 52): hu.4 (SEQ ID NO: 47); and hu.67 (SEQ ID NO: 215). These sequences are also reproduced in the Sequence Listing, which is incorporated by reference herein.

DETAILED DESCRIPTION OF THE INVENTION

Figure 1:
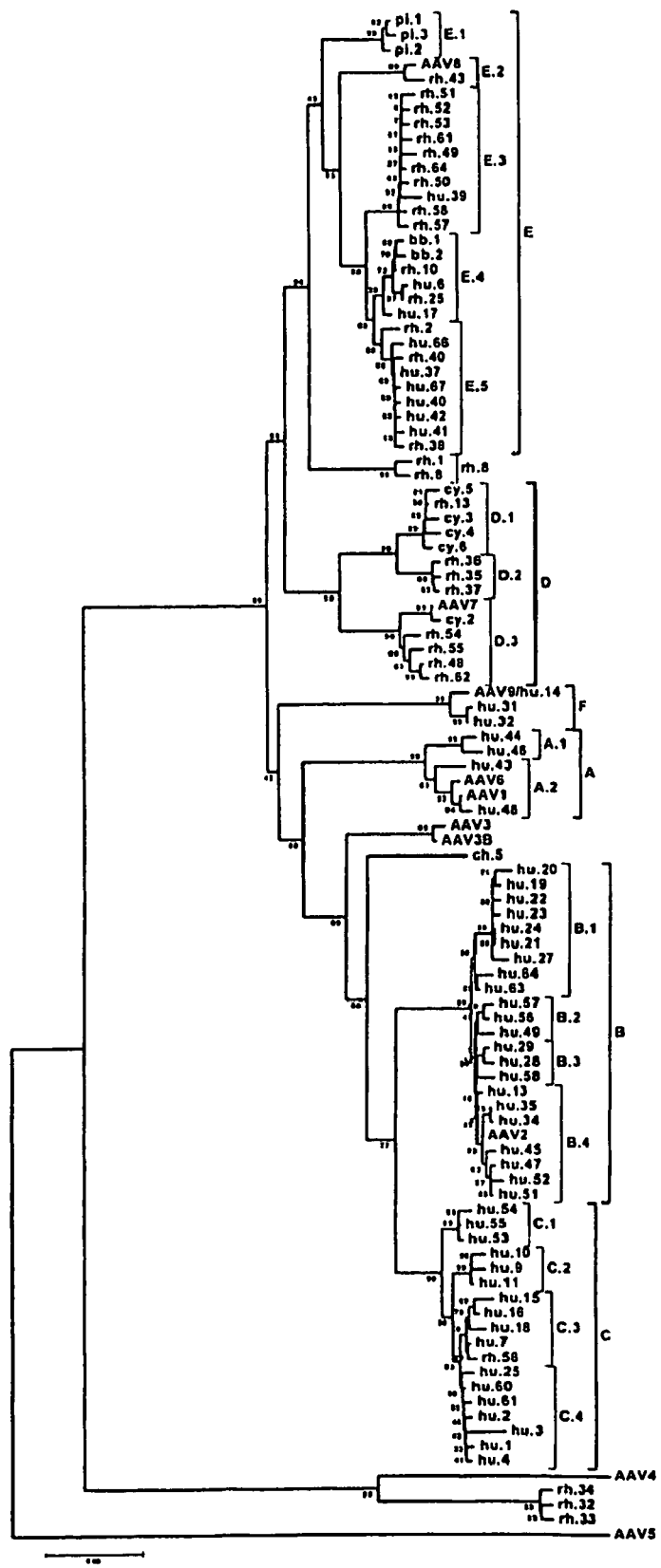
FIG. 1 is a tree showing the phylogenic relationship constructed using the Neighbor-Joining heuristic with Poisson correction distance measurement. The relationship was determined based on the isolated AAV vp1 capsid protein, with the isolated AAV grouped in clades. Groups of individual capsid clones are classified in clades based on their common ancestry. Clade nomenclature goes from A through F; subtypes are represented by the clade letter followed by a number.
Figure 4A:
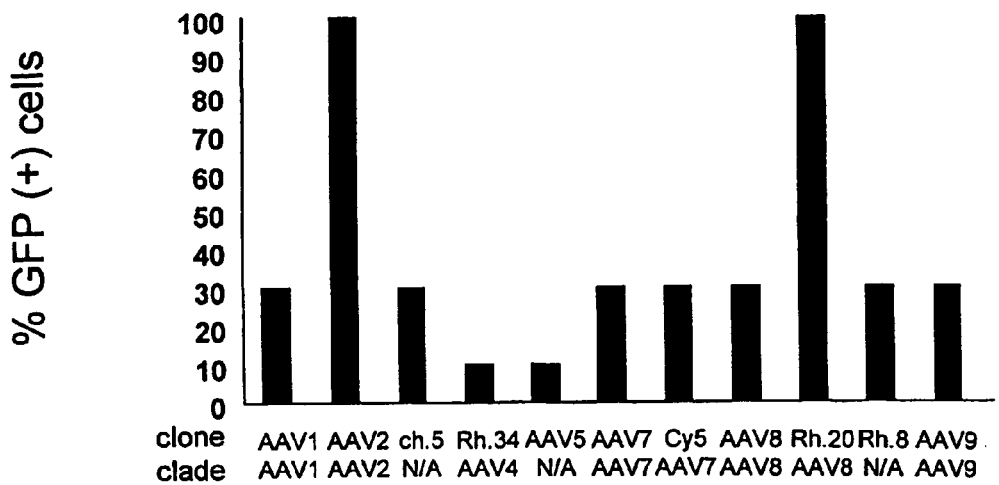
FIGS. 4A-4D provide an evaluation of gene transfer efficiency of novel primate AAV-based vectors in vitro and in vivo. AAV vectors were pseudotyped as described [Gao et al, *Proc Natl Acad Sci USA*, 99:11854-11859 (Sept. 3, 2002)] with capsids of AAVs 1, 2, 5, 7, 8 and 6 and ch.5, rh.34, cy.5, rh.20, rh.8 and AAV9. For in vitro study, FIG. 4A, 84-32 cells (293 cells expressing E4 of adenovirus serotypes) seeded in a 95 well plate were infected with pseudotyped AAVCM-VEGFP vectors at an MOI of $1 \times 10^4$ GC per cell. Relative EGFP transduction efficiency was estimated as percentage of green cells using a UV microscope at 48 hours post-infection and shown on the Y axis. For in vivo study, the vectors expressing the secreted reporter gene A1AT were administered to the liver (FIG. 4B), lung (FIG. 4C) and muscle (FIG. 4D) of NCR nude mice (4-6 weeks old) at a dose of $1 \times 10^{11}$ GC per animal by intraportal (FIG. 4B), intratracheal (FIG. 4C) and intramuscular injections (FIG. 4D), respectively. Serum A1AT levels (ng/mL) were compared at day 28 post gene transfer and presented on the Y axis. The X axis indicates the AAVs analyzed and the clades to which they belong.
Figure 4B:
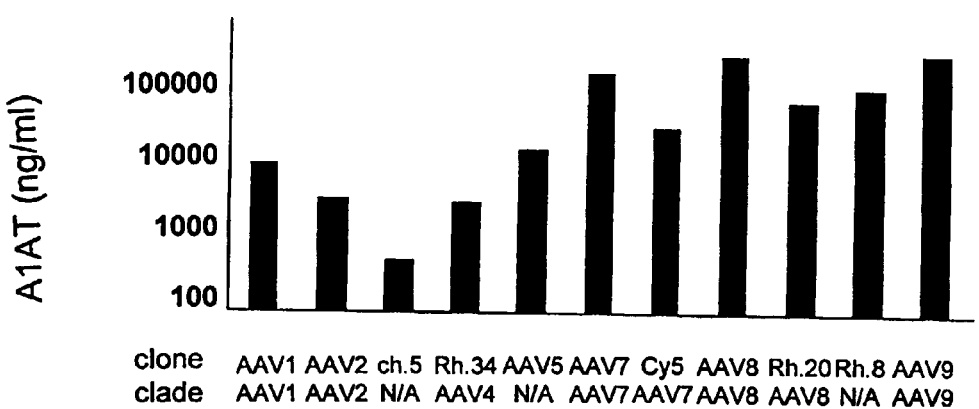
Figure 4C:
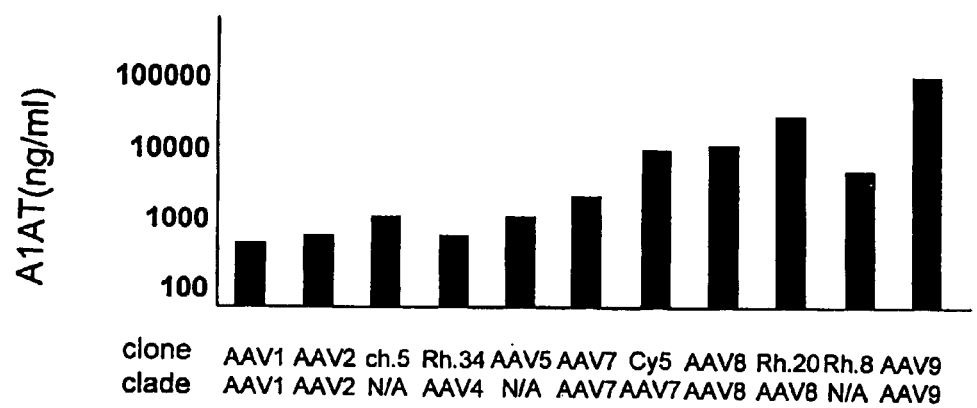
Figure 4D:
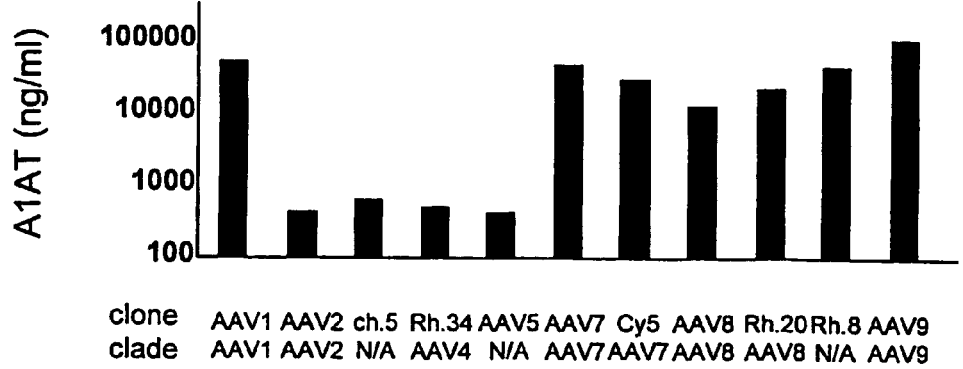

In any arsenal of vectors useful in therapy or prophylaxis, a variety of distinct vectors capable of carrying a macromolecule to a target cell is desirable, in order to permit selection of a vector source for a desired application. To date, one of the concerns regarding the use of AAV as vectors was the lack of a variety of different virus sources. One way in which the present invention overcomes this problem is by providing clades of AAV, which are useful for selecting phylogenetically related, or where desired for a selected regimen, phylogenetically distinct, AAV and for predicting function. The invention further provides novel AAV viruses.

The term "substantial homology" or "substantial similarity," when referring to a nucleic acid, or fragment thereof, indicates that, when optimally aligned with appropriate nucleotide insertions or deletions with another nucleic acid (or its complementary strand), there is nucleotide sequence identity in at least about 95 to 99% of the aligned sequences. Preferably, the homology is over full-length sequence, or an open reading frame thereof, or another suitable fragment which is at least 15 nucleotides in length. Examples of suitable fragments are described herein.

The terms "sequence identity" "percent sequence identity" or "percent identical" in the context of nucleic acid sequences refers to the residues in the two sequences which are the same when aligned for maximum correspondence. The length of sequence identity comparison may be over the full-length of the genome, the full-length of a gene coding sequence, or a fragment of at least about 500 to 5000 nucleotides, is desired. However, identity among smaller fragments, e.g. of at least about nine nucleotides, usually at least about 20 to 24 nucleotides, at least about 28 to 32 nucleotides. at least about 36 or more nucleotides, may also be desired. Similarly, "percent sequence identity" may be readily determined for amino acid sequences, over the full-length of a protein, or a fragment thereof. Suitably, a fragment is at least about 8 amino acids in length, and may be up to about 700 amino acids. Examples of suitable fragments are described herein.

The term "substantial homology" or "substantial similarity," when referring to amino acids or fragments thereof, indicates that, when optimally aligned with appropriate amino acid insertions or deletions with another amino acid (or its complementary strand), there is amino acid sequence identity in at least about 95 to 99% of the aligned sequences. Preferably, the homology is over full-length sequence, or a protein thereof, e.g., a cap protein, a rep protein, or a fragment thereof which is at least 8 amino acids, or more desirably, at least 15 amino acids in length. Examples of suitable fragments are described herein.

By the term "highly conserved" is meant at least 80% identity, preferably at least 90% identity, and more preferably, over 97% identity. Identity is readily determined by one of skill in the art by resort to algorithms and computer programs known by those of skill in the art.

Generally, when referring to "identity", "homology", or "similarity" between two different adeno-associated viruses, "identity", "homology" or "similarity" is determined in reference to "aligned" sequences. "Aligned" sequences or "alignments" refer to multiple nucleic acid sequences or protein (amino acids) sequences, often containing corrections for missing or additional bases or amino acids as compared to a reference sequence. In the examples, AAV alignments are performed using the published AAV2 or AAV1 sequences as a reference point. However, one of skill in the art can readily select another AAV sequence as a reference.

Alignments are performed using any of a variety of publicly or commercially available Multiple Sequence Alignment Programs. Examples of such programs include, "Clustal W", "CAP Sequence Assembly", "MAP", and "MEME", which are accessible through Web Servers on the internet. Other sources for such programs are known to those of skill in the art. Alternatively, Vector NTI utilities are also used. There are also a number of algorithms known in the art that can be used to measure nucleotide sequence identity, including those contained in the programs described above. As another example, polynucleotide sequences can be compared using Fasta™, a program in GCG Version 6.1. Fasta™ provides alignments and percent sequence identity of the regions of the best overlap between the query and search sequences. For instance, percent sequence identity between nucleic acid sequences can be determined using Fasta™ with its default parameters (a word size of 6 and the NOPAM factor for the scoring matrix) as provided in GCG Version 6.1, herein incorporated by reference. Multiple sequence alignment programs are also available for amino acid sequences, e.g., the "Clustal X", "MAP", "PIMA", "MSA", "BLOCKMAKER", "MEME", and "Match-Box" programs. Generally, any of these programs are used at default settings, although one of skill in the art can alter these settings as needed. Alternatively, one of skill in the art can utilize another algorithm or computer program which provides at least the level of identity or alignment as that provided by the referenced algorithms and programs. See, e.g., J. D. Thomson et al, Nucl. Acids. Res., "A comprehensive comparison of multiple sequence alignments", 27(13):2682-2690 (1999).

The term "serotype" is a distinction with respect to an AAV having a capsid which is serologically distinct from other AAV serotypes. Serologic distinctiveness is determined on the basis of the lack of cross-reactivity between antibodies to the AAV as compared to other AAV.

Cross-reactivity is typically measured in a neutralizing antibody assay. For this assay polyclonal serum is generated against a specific AAV in a rabbit or other suitable animal model using the adeno-associated viruses. In this assay, the serum generated against a specific AAV is then tested in its ability to neutralize either the same (homologous) or a heterologous AAV. The dilution that achieves 50% neutralization is considered the neutralizing antibody titer. If for two AAVs the quotient of the heterologous titer divided by the homologous titer is lower than 16 in a reciprocal manner, those two vectors are considered as the same serotype. Conversely, if the ratio of the heterologous titer over the homologous titer is 16 or more in a reciprocal manner the two AAVs are considered distinct serotypes.

As defined herein, to form serotype 9, antibodies generated to a selected AAV capsid must not be cross-reactive with any of AAV 1, AAV2, AAV3, AAV4, AAV5, AAV6, AAV7 or AAV8. In one embodiment, the present invention provides an AAV capsid of a novel serotype, identified herein, as human AAV serotype 9.

As used throughout this specification and the claims, the terms "comprising" and "including" are inclusive of other components, elements, integers, steps and the like. Conversely, the term "consisting" and its variants are exclusive of other components, elements, integers, steps and the like.

I. Clades

In one aspect, the invention provides clades of AAV. A lade is a group of AAV which are phylogenetically related to one another as determined using a Neighbor-Joining algorithm by a bootstrap value of at least 75% (of at least 1000 replicates) and a Poisson correction distance measurement of no more than 0.05, based on alignment of the AAV vp1 amino acid sequence.

The Neighbor-Joining algorithm has been described extensively in the literature. See, e.g., M. Nei and S. Kumar, *Molecular Evolution and Phylogenetics* (Oxford University Press, New York (2000). Computer programs are available that can be used to implement this algorithm. For example, the MEGA v2.1 program implements the modified Nei-Gojobori method. Using these techniques and computer programs, and the sequence of an AAV vp1 capsid protein, one of skill in the art can readily determine whether a selected AAV is contained in one of the clades identified herein, in another clade, or is outside these clades.

While the clades defined herein are based primarily upon naturally occurring AAV vp1 capsids, the clades are not limited to naturally occurring AAV. The clades can encompass non-naturally occurring AAV, including, without limitation, recombinant, modified or altered, chimeric, hybrid, synthetic, artificial, etc., AAV which are phylogenetically related as determined using a Neighbor-Joining algorithm at least 75% (of at least 1000 replicates) and a Poisson correction distance measurement of no more than 0.05, based on alignment of the AAV vp1 amino acid sequence.

The clades described herein include Clade A (represented by AAV1 and AAV6), Clade B (represented by AAV2) and Clade C (represented by the AAV2-AAV3 hybrid), Clade D (represented by AAV7), Clade E (represented by AAV8), and Clade F (represented by human AAV9). These clades are represented by a member of the clade that is a previously described AAV serotype. Previously described AAV1 and AAV6 are members of a single clade (Clade A) in which 4 isolates were recovered from 3 humans. Previously described AAV3 and AAV5 serotypes are clearly distinct from one another, but were not detected in the screen described herein, and have not been included in any of these clades.

Clade B (AAV2) and Clade C (the AAV2-AAV3 hybrid) are the most abundant of those found in humans (22 isolates from 12 individuals for AAV2 and 17 isolates from 8 individuals for Clade C).

There are a large number of sequences grouped in either Clade D (AAV7) or Clade E (AAV8). Interestingly, both of these clades are prevalent in different species. Clade D is unique to rhesus and cynomologus macaques with 15 members being isolated from 10 different animals. Clade E is interesting because it is found in both human and nonhuman primates: 9 isolates were recovered from 7 humans and 21 isolates were obtained in 9 different nonhuman primates including rhesus macaques, a baboon and a pigtail monkey.

In two other animals the hybrid nature of certain sequences was proven, although all sequences in this case seem to have originated through individual and different recombinations of two co-infecting viruses (in both animals a Clade D with a Clade E virus). None of these recombinants were identified in other animals or subjects.

Since Clade C (the AAV2-AAV3 hybrid) clade was identified in 6 different human subjects, the recombination event resulted in a fit progeny. In the case of the AAV7-AAV8 hybrids on the other hand, only few conclusions can be drawn as to the implication of recombination in AAV evolution. These recombination events show that AAV is capable of recombining, thereby creating in-frame genes and in some cases packagable and/or infectious capsid structures. Clade C (the AAV2-AAV3 hybrid clade) on the other hand is a group of viruses that has acquired a selective advantage through recombination that made them sustain certain environmental pressures.

A. Clade A (Represented by AAV1 and AAV6):

In another aspect, the invention provides Clade A, which is characterized by containing the previously published AAV1 and AAV6. See, e.g., International Publication No. WO 00/28061, 18 May 2000; Rutledge et al, *J Virol,* 72(1):309-319 (January 1998). In addition, this lade contains novel AAV including, without limitation, 128.1/hu. 43 [SEQ ID NOs: 80 and 160]; 128.3/hu. 44 [SEQ ID Nos: 81 and 158]; 130.4/hu.48 [SEQ ID NO: 78 and 157]; and hu.46 [SEQ ID NOs: 82 and 159]. The invention further provides a modified hu. 43 capsid [SEQ ID NO:236] and a modified hu. 46 capsid [SEQ ID NO:224].

In one embodiment, one or more of the members of this lade has a capsid with an amino acid identity of at least 85% identity, at least 90% identity, at least 95% identity, or at least 97% identity over the full-length of the vp1, the vp2, or the vp3 of the AAV1 and/or AAV6 capsid.

In another embodiment, the invention provides novel AAV of Clade A, provided that none of the novel AAV comprises a capsid of any of AAV1 or AAV6. These AAV may include, without limitation, an AAV having a capsid derived from one or more of 128.1/hu. 43 [SEQ ID Nos: 80 and 160]; modified hu.43 [SEQ ID NO:236] 128.3/hu. 44 [SEQ ID Nos: 81 and 158]; hu.46 [SEQ ID NOs: 82 and 159]; modified hu. 46 [SEQ ID NO:224]; and 130.4/hu.48 [SEQ ID NO: 78 and 157].

B. Clade B (AAV2 Clade):

In another embodiment, the invention provides a Clade B. This clade is characterized by containing, at a minimum, the previously described AAV2 and novel AAV of the invention including, 52/hu.19 [SEQ ID NOs: 62 and 133], 52.1/hu.20 [SEQ ID NOs: 63 and 134], 54.5/hu.23 [SEQ ID Nos: 60 and 137], 54.2/hu.22 [SEQ ID Nos: 67 and 138], 54.7/hu.24 [SEQ ID Nos: 66 and 136], 54.1/hu.21 [SEQ ID Nos: 65 and 135], 54.4R/hu.27 [SEQ ID Nos: 64 and 140]; 46.2/hu.28 [SEQ ID Nos: 68 and 130]; 46.6/hu.29 [SEQ ID Nos: 69 and 132]; modified hu. 29 [SEQ ID NO: 225]; 172.1/hu.63 [SEQ ID NO: 171 and 195; GenBank Accession No. AY530624]; 172.2/hu. 64 [SEQ ID NO: 172 and 196; GenBank Accession No. AY530625]; 24.5/hu.13 [SEQ ID NO: 71 and 129; GenBank Accession No. AY530578]; 145.6/hu.56 [SEQ ID NO: 168 and 192]; hu.57 [SEQ ID Nos: 169 and 193]; 136.1/hu.49 [SEQ ID NO: 165 and 189; 156.1/hu.58 [SEQ ID NO: 179 and 194]; 72.2/hu.34 [SEQ ID NO: 72 and 125; GenBank Accession No. AY530598]; 72.3/hu.35 [SEQ ID NO: 73 and 164; GenBank Accession No. AY530599]; 130.1/hu.47 [SEQ ID NO: 77 and 128]; 129.1/hu.45 (SEQ ID NO: 76 and 127; GenBank Accession No. AY530608); 140.1/hu.51 [SEQ ID NO: 161 and 190; GenBank Accession No. AY530613]; and 140.2/hu.52 [SEQ ID NO: 167 and 191; GenBank Accession No. AY530614].

In one embodiment, one or more of the members of this clade has a capsid with an amino acid identity of at least 85% identity, at least 90% identity, at least 95% identity, or at least 97% identity over the full-length of the vp1, the vp2, or the vp3 of the AAV2 capsid.

In another embodiment, the invention provides novel AAV of Clade B, provided that none of the AAV has an AAV2 capsid. These AAV may include, without limitation, an AAV having a capsid derived from one or more of the following: 52/hu. 19 [SEQ ID NOs: 62 and 133], 52.1/hu.20 [SEQ ID NOs: 63 and 134], 54.5/hu.23 [SEQ ID Nos: 60 and 137], 54.2/hu.22 [SEQ ID Nos: 67 and 138], 54.7/hu.24 [SEQ ID Nos: 66 and 136], 54.1/hu.21 [SEQ ID Nos: 65 and 135], 54.4R/hu.27 [SEQ ID Nos: 64 and 140]; 46.2/hu.28 [SEQ ID Nos: 68 and 130]; 46.6/hu.29 [SEQ ID Nos: 69 and 132]; modified hu. 29 [SEQ ID NO: 225]; 172.1/hu.63 [SEQ ID NO: 171 and 195]; 172.2/hu. 64 [SEQ ID NO: 172 and 196]; 24.5/hu.13 [SEQ ID NO: 71 and 129]; 145.6/hu.56 [SEQ ID NO:. 168 and 192; GenBank Accession No. AY530618]; hu.57 [SEQ ID Nos: 169 and 193; GenBank Accession No. AY530619]; 136.1/hu.49 [SEQ ID NO: 165 and 189; GenBank Accession No. AY530612]; 156.1/hu.58 [SEQ ID NO: 179 and 194; GenBank Accession No. AY530620]; 72.2/hu.34 [SEQ ID NO: 72 and 125]; 72.3/hu.35 [SEQ ID NO: 73 and 164]; 129.1/hu.45 [SEQ ID NO: 76 and 127]; 130.1/hu.47 [SEQ ID NO:77 and 128; GenBank Accession No. AY530610]; 140.1/hu.51 [SEQ ID NO: 161 and 190; GenBank Accession No. AY530613]; and 140.2/hu.52 [SEQ ID NO: 167 and 191; GenBank Accession No. AY530614].

C. Clade C (AAV2-AAV3 Hybrid Clade)

In another aspect, the invention provides Clade C, which is characterized by containing AAV that are hybrids of the previously published AAV2 and AAV3 such as H-6/hu.4; H-2/hu.2 [U.S. Patent Application 2003/0138772 (Jun. 24, 2003). In addition, this clade contains novel AAV including, without limitation, 3.1/hu.9 [SEQ ID Nos: 58 and 155]; 16.8/hu.10 [SEQ ID Nos: 56 and 156]; 16.12/hu.11 [SEQ ID Nos: 57 and 153]; 145.1/hu.53 [SEQ ID Nos: 176 and 186]; 145.6/hu.55 [SEQ ID Nos: 178 and 187]; 145.5/hu.54 [SEQ ID Nos: 177 and 188]; 7.3/hu.7 [SEQ ID Nos: 55 and 150; now deposited as GenBank Accession No. AY530628]; modified hu. 7 [SEQ ID NO: 226]; 33.4/hu.15 [SEQ ID Nos: 50 and 147]; 33.8/hu.16 [SEQ ID Nos: 51 and 148]; hu.18 [SEQ ID NOs: 52 and 149]; 58.2/hu.25 [SEQ ID Nos: 49 and 146]; 161.10/hu.60 [SEQ ID Nos: 170 and 184]; H-5/hu.3 [SEQ ID Nos: 44 and 145]; H-1 /hu.1 [SEQ ID Nos: 46 and 144]; and 161.6/hu.61 [SEQ ID Nos: 174 and 185].

In one embodiment, one or more of the members of this clade has a capsid with an amino acid identity of at least 85% identity, at least 90% identity, at least 95% identity, or at least 97% identity over the full-length of the vp1, the vp2, or the vp3 of the hu.4 and/or hu.2 capsid.

In another embodiment, the invention provides novel AAV of Clade C (the AAV2-AAV3 hybrid clade), provided that none of the novel AAV comprises a capsid of hu.2 or hu.4. These AAV may include, without limitation, an AAV having a capsid derived from one or more of 3.1/hu.9 [SEQ ID Nos: 58 and 155]; 16.8/hu. 10 [SEQ ID Nos: 56 and 156]; 16.12/hu.11 [SEQ ID Nos: 57 and 153]; 145.1/hu.53 [SEQ ID Nos: 176 and 186]; 145.6/hu.55 [SEQ ID Nos: 178 and 187]; 145.5/hu.54 [SEQ ID Nos: 177 and 188]; 7.3/hu.7 [SEQ ID Nos: 55 and 150]; modified hu.7 [SEQ ID NO:226]; 33.4/hu.15 [SEQ ID Nos: 50 and 147]; 33.8/hu.16 [SEQ ID Nos: 51 and 148]; 58.2/hu.25 [SEQ ID Nos: 49 and 146]; 161.10/hu.60 [SEQ ID Nos: 170 and 184]; H-5/hu.3 [SEQ ID Nos: 44 and 145]; H-1/hu.1 [SEQ ID Nos: 46 and 144]; and 161.6/hu.61 [SEQ ID Nos: 174 and 185].

D. Clade D (AAV7 Clade)

In another embodiment, the invention provides Clade D. This clade is characterized by containing the previously described AAV7 [G. Gao et al, *Proc. Natl Acad Sci USA*, 99:11854-9 (Sep. 3, 2002). The nucleic acid sequences encoding the AAV7 capsid are reproduced in SEQ ID NO: 184; the amino acid sequences of the AAV7 capsid are reproduced in SEQ ID NO: 185. In addition, the clade contains a number of previously described AAV sequences, including: cy.2; cy.3; cy.4; cy.5; cy.6; rh.13; rh.37; rh. 36; and rh.35 [U.S. Published Patent Application No. US 2003/0138772 A1 (Jul. 24, 2003)]. Additionally, the AAV7 clade contains novel AAV sequences, including, without limitation, 2-15/rh.62 [SEQ ID Nos: 33 and 114]; 1-7/rh.48 [SEQ ID Nos: 32 and 115]; 4-9/rh.54 [SEQ ID Nos: 40 and 116]; and 4-19/rh.55 [SEQ ID Nos: 37 and 117]. The invention further includes modified cy. 5 [SEQ ID NO: 227]; modified rh.13 [SEQ ID NO: 228]; and modified rh. 37 [SEQ ID NO: 229].

In one embodiment, one or more of the members of this clade has a capsid with an amino acid identity of at least 85% identity, at least 90% identity, at least 95% identity, or at least 97% identity over the full-length of the vp1, the vp2, or the vp3 of the AAV7 capsid, SEQ ID NO: 184 and 185.

In another embodiment, the invention provides novel AAV of Clade D, provided that none of the novel AAV comprises a capsid of any of cy.2; cy.3; cy.4; cy.5; cy.6; rh.13; rh.37; rh. 36; and rh.35. These AAV may include, without limitation, an AAV having a capsid derived from one or more of the following 2-15/rh.62 [SEQ ID Nos: 33 and 114]; 1-7/rh.48 [SEQ ID Nos: 32 and 115]; 4-9/rh.54 [SEQ ID Nos 40 and 116]; and 4-19/rh.55 [SEQ ID Nos: 37 and 117].

E. Clade E (AAV8 Clade)

In one aspect, the invention provides Clade E. This clade is characterized by containing the previously described AAV8 [G. Gao et al, Proc. Natl Acad. Sci USA. 99:11854-9 (Sep. 3, 2002)], 43.1/rh.2; 44.2/rh.10; rh. 25; 29.3/bb.1; and 29.5/bb.2 [U.S. Published Patent Application No. US 2003/0138772 A1 (Jul. 24, 2003)].

Further, the clade novel AAV sequences, including, without limitation, including, e.g., 30.10/pi.1 [SEQ ID NOs: 28 and 93), 30.12/pi.2 [SEQ ID NOs: 30 and 95, 30.19/pi.3 [SEQ ID NOs: 29 and 94], LG-4/rh.38 [SEQ ID Nos: 7 and 86]; LG-10/rh.40 [SEQ ID Nos: 14 and 92]; N721-8/rh.43 [SEQ ID Nos: 43 and 163]; 1-8/rh.49 ]SEQ ID NOs: 25 and 103]; 2-4/rh.50 [SEQ ID Nos: 23 and 108]; 2-5/rh.51 [SEQ ID Nos: 22 and 104]; 3-9/rh.52 [SEQ ID Nos: 18 and 96]; 3-11/rh.53 [SEQ ID NOs: 17 and 97]; 5-3/rh.57 [SEQ ID Nos: 26 and 105]; 5-22/rh.58 [SEQ ID Nos: 27 and 58]; 2-3/rh.61 [SEQ ID NOs: 21 and 107]; 4-8/rh.64 [SEQ ID Nos: 15 and 99]; 3.1/hu.6 [SEQ ID NO: 5 and 84]; 33.12/hu.17 [SEQ ID NO:4 and 83]; 106.1/hu.37 [SEQ ID Nos: 10 and 88]; LG-9/hu.39 [SEQ ID Nos: 24 and 102]; 114.3/hu. 40 [SEQ ID Nos: 11 and 87]; 127.2/hu.41 [SEQ ID NO:6 and 91]; 127.5/hu.42 [SEQ ID Nos: 8 and 85]; hu. 66 [SEQ ID NOs: 173 and 197]; and hu.67 [SEQ ID NOs: 174 and 198]. This clade further includes modified rh. 2 [SEQ ID NO: 231]; modified rh. 58 [SEQ ID NO: 232]; modified rh. 64 [SEQ ID NO: 233].

In one embodiment, one or more of the members of this clade has a capsid with an amino acid identity of at least 85% identity, at least 90% identity, at least 95% identity, or at least 97% identity over the full-length of the vp1, the vp2, or the vp3 of the AAV8 capsid. The nucleic acid sequences encoding the AAV8 capsid are reproduced in SEQ ID NO: 186 and the amino acid sequences of the capsid are reproduced in SEQ ID NO:187.

In another embodiment, the invention provides novel AAV of Clade E, provided that none of the novel AAV comprises a capsid of any of AAV8. rh.8: 44.2/rh.10; rh. 25; 29.3/bb.1; and 29.5/bb.2 [U.S. Published Patent Application No. US 2003/0138772 A1 (Jul. 24, 2003)]. These AAV may include, without limitation, an AAV having a capsid derived from one or more of the following: 30.10/pi.1 [SEQ ID NOs:28 and 93], 30.12/pi.2 [SEQ ID NOs:30 and 95, 30.19/pi.3 [SEQ ID NOs:29 and 94]. L.G-4/rh.38 [SEQ ID Nos: 7 and 86]; LG-10/rh.40 [SEQ ID Nos: 14 and 92]; N721-8/rh.43 [SEQ ID Nos: 43 and 163]; 1-8/rh.49 [SEQ ID NOs: 25 and 103]; 2-4/rh.50 [SEQ ID Nos: 23 and 108]; 2-5/rh.51 [SEQ ID Nos: 22 and 104]; 3-9/rh.52 [SEQ ID Nos: 18 and 96]; 3-11/rh.53 [SEQ ID NOs: 17 and 97]; 5-3/rh.57 [SEQ ID Nos: 26 and 105]; 5-22/rh.58 [SEQ ID Nos: 27 and 58]; modified rh. 58 [SEQ ID NO: 232]: 2-3/rh.61 [SEQ ID NOs: 21 and 107]; 4-8/rh.64 [SEQ ID Nos: 15 and 99]; modified rh. 64[SEQ ID NO: 233]; 3.1/hu.6 [SEQ ID NO: 5 and 84]; 33.12/hu.17 [SEQ ID NO:4 and 83]; 106.1/hu.37 [SEQ ID Nos: 10 and 88]; LG-9/hu.39 [SEQ ID Nos: 24 and 102]; 114.3/hu. 40 [SEQ ID Nos: 11 and 87]; 127.2/hu.41 [SEQ ID NO:6 and 91]; 127.5/hu.42 [SEQ ID Nos: 8 and 85]; hu. 66 [SEQ ID NOs: 173 and 197]; and hu.67 [SEQ ID NOs: 174 and 198].

F. Clade F (AAV 9 Clade)

This clade is identified by the name of a novel AAV serotype identified herein as hu.14/AAV9 [SEQ ID Nos: 3 and 123]. In addition, this clade contains other novel sequences including, hu.31 [SEQ ID NOs:1 and 121]; and hu.32 [SEQ ID Nos: 2 and 122].

In one embodiment, one or more of the members of this lade has a capsid with an amino acid identity of at least 85% identity, at least 90% identity, at least 95% identity, or at least 97% identity over the full-length of the vp1, the vp2, or the vp3 of the AAV9 capsid, SEQ ID NO: 3 and 123.

In another embodiment, the invention provides novel AAV of Clade F. which include, without limitation, an AAV having a capsid derived from one or more of hu.14/AAV9 [SEQ ID Nos: 3 and 123], hu.31 [SEQ ID NOs: 1 and 121] and hu.32 [SEQ ID Nos: 1 and 122].

The AAV clades of the invention are useful for a variety of purposes, including providing ready collections of related AAV for generating viral vectors, and for generating targeting molecules. These clades may also be used as tools for a variety of purposes that will be readily apparent to one of skill in the art.

II. Novel AAV Sequences

The invention provides the nucleic acid sequences and amino acids of a novel AAV serotype, which is termed interchangeably herein as clone hu.14/28.4 and huAAV9. These sequences are useful for constructing vectors that are highly efficient in transduction of liver, muscle and lung. This novel AAV and its sequences are also useful for a variety of other purposes. These sequences are being submitted with Gen-Bank and have been assigned the accession numbers identified herein.

The invention further provides the nucleic acid sequences and amino acid sequences of a number of novel AAV. Many of these sequence include those described above as members of a clade, as summarized below.

128.1/hu. 43 [SEQ ID Nos: 80 and 160 GenBank Accession No. AY530606]; modified hu. 43 [SEQ ID NO:236]; 128.3/hu. 44 [SEQ ID Nos: 81 and 158; GenBank Accession No. AY530607] and 130.4/hu.48 [SEQ ID NO: 78 and 157; GenBank Accession No. AY530611]; from the Clade A;

52/hu.19 [SEQ ID NOs: 62 and 133; GenBank Accession No. AY530584], 52.1/hu.20 [SEQ ID NOs: 63 and 134; GenBank Accession No. AY530586], 54.5/hu.23 [SEQ ID Nos: 60 and 137; GenBank Accession No. AY530589], 54.2/hu.22 [SEQ ID Nos: 67 and 138; GenBank Accession No.

AY530588], 54.7/hu.24 [SEQ ID Nos: 66 and 136; GenBank Accession No. AY530590], 54.1/hu.21 [SEQ ID Nos: 65 and 135; GenBank Accession No. AY530587], 54.4R/hu.27 [SEQ ID Nos: 64 and 140; GenBank Accession No. AY530592]; 46.2/hu.28 [SEQ ID Nos: 68 and 130; GenBank Accession No. AY530593]; 46.6/hu.29 [SEQ ID Nos: 69 and 132; GenBank Accession No. AY530594]; modified hu. 29 [SEQ ID NO: 225]; 172.1/hu.63 [SEQ ID NO: 171 and 195]; and 140.2/hu.52 (SEQ ID NO: 167 and 191; from Clade B;

3.1/hu.9 [SEQ ID Nos: 58 and 155; GenBank Accession No. AY530626]; 16.8/hu.10 [SEQ ID Nos: 56 and 156; GenBank Accession No. AY530576]; 16.12/hu. 11 [SEQ ID Nos: 57 and 153; GenBank Accession No. AY530577]; 145.1/hu.53 [SEQ ID Nos: 176 and 186; GenBank Accession No. AY530615]; 145.6/hu.55 [SEQ ID Nos: 178 and 187; GenBank Accession No. AY530617]; 145.5/hu.54 [SEQ ID Nos: 177 and 188; GenBank Accession No. AY530616]; 7.3/hu.7 [SEQ ID Nos: 55 and 150; GenBank Accession No. AY530628]; modified hu. 7 [SEQ ID NO: 226]; hu.18 [SEQ ID Nos: 52 and 149; GenBank Accession No. AY530583]; 33.4/hu.15 [SEQ ID Nos: 50 and 147; GenBank Accession No. AY530580]; 33.8/hu.16 [SEQ ID Nos: 51 and 148; GenBank Accession No. AY530581]; 58.2/hu.25 [SEQ ID Nos: 49 and 146: GenBank Accession No. AY530591]; 161.10/hu.60 [SEQ ID Nos: 170 and 184; GenBank Accession No. AY530622]; H-5/hu.3 [SEQ ID Nos: 44 and 145; GenBank Accession No. AY530595]; H-1/hu.1 [SEQ ID Nos: 46 and 144; GenBank Accession No. AY530575]; and 161.6/hu.61 [SEQ ID Nos: 174 and 185; GenBank Accession No. AY530623] from Clade C;

2-15/rh.62 [SEQ ID Nos: 33 and 114; GenBank Accession No. AY530573]; 1-7/rh.48 [SEQ ID Nos: 32 and 115; GenBank Accession No. AY530561]: 4-9/rh.54 [SEQ ID Nos: 40 and 116; GenBank Accession No. AY530567]; and 4-19/rh.55 [SEQ ID Nos: 37 and 117; GenBank Accession No. AY530568]; modified cy. 5 [SEQ ID NO: 227]; modified rh.13 [SEQ ID NO: 228]; and modified rh. 37 [SEQ ID NO: 229] from the Clade D;

30.10/pi.1 [SEQ ID NOs:28 and 93; GenBank Accession No. AY53055], 30.12/pi.2 [SEQ ID NOs:30 and 95; GenBank Accession No. AY 530554], 30.19/pi.3 [SEQ ID NOs:29 and 94; GenBank Accession No. AY530555], LG-4/rh.38 [SEQ ID Nos: 7 and 86; GenBank Accession No. AY 530558]; LG-10/rh.40 [SEQ ID Nos: 14 and 92; GenBank Accession No. AY530559]; N721-8/rh.43 [SEQ ID Nos: 43 and 163; GenBank Accession No. AY530560]; 1-8/rh.49 [SEQ ID NOs: 25 and 103; GenBank Accession No. AY530561]; 2-4/rh.50 [SEQ ID Nos: 23 and 108; GenBank Accession No. AY530563]; 2-5/rh.51 [SEQ ID Nos: 22 and 104; GenBank Accession No. 530564]; 3-9/rh.52 [SEQ ID Nos: 18 and 96; GenBank Accession No. AY530565]; 3-11/rh.53 [SEQ ID Nos: 17 and 97; GenBank Accession No. AY530566]; 5-3/rh.57 [SEQ ID Nos: 26 and 105; GenBank Accession No. AY530569]; 5-22/rh.58 [SEQ ID Nos: 27 and 58; GenBank Accession No. 530570]; modified rh. 58 [SEQ ID NO: 232]; 2-3/rh.61 [SEQ ID Nos: 21 and 107; GenBank Accession No. AY530572]; 4-8/rh.64 [SEQ ID Nos: 15 and 99; GenBank Accession No. AY530574]; modified rh. 64[SEQ ID NO: 233]; 3.1/hu.6 [SEQ ID NO: 5 and 84; GenBank Accession No. AY530621]; 33.12/hu.17 [SEQ ID NO:4 and 83; GenBank Accession No. AY530582]; 106.1/hu.37 [SEQ ID Nos: 10 and 88; GenBank Accession No. AY530600]; LG-9/hu.39 [SEQ ID Nos: 24 and 102; GenBank Accession No. AY530601]; 114.3/hu. 40 [SEQ ID Nos: 11 and 87; GenBank Accession No. AY530603]; 127.2/hu.41 [SEQ ID NO:6 and 91; GenBank Accession No. AY530604]; 127.5/hu.42 [SEQ ID Nos: 8 and 85; GenBank Accession No. AY530605]; and hu. 66 [SEQ ID NOs: 173 and 197; GenBank Accession No. AY530626]; and hu.67 [SEQ ID NOs: 174 and 198; GenBank Accession No. AY530627]; and modified rh.2 [SEQ ID NO:231]; from Clade E;

hu.14/AAV9 [SEQ ID Nos: 3 and 123; GenBank Accession No. AY530579], hu.31 [SEQ ID NOs:1 and 121; AY530596] and hu.32 [SEQ ID Nos: 1 and 122; GenBank Accession No. AY530597] from Clade F.

In addition, the present invention provides AAV sequences, including, rh.59 [SEQ ID NO: 49 and 110]; rh.60 [SEQ ID NO: 31 and 120; GenBank Accession No. AY530571], modified ch.5 [SEQ ID NO: 234]; and modified rh. 8 [SEQ ID NO: 235], which are outside the definition of the clades described above.

Also provided are fragments of the AAV sequences of the invention. Each of these fragments may be readily utilized in a variety of vector systems and host cells. Among desirable AAV fragments are the cap proteins, including the vp1, vp2, vp3 and hypervariable regions. Where desired, the methodology described in published U.S. Patent Publication No. US 2003/0138772 A1 (Jul. 24, 2003)] can be used to obtain the rep sequences for the AAV clones identified above. Such rep sequences include, e.g., rep 78, rep 68, rep 52, and rep 40, and the sequences encoding these proteins. Similarly, other fragments of these clones may be obtained using the techniques described in the referenced patent publication, including the AAV inverted terminal repeat (ITRs), AAV P19 sequences, AAV P40 sequences, the rep binding site, and the terminal resolute site (TRS). Still other suitable fragments will be readily apparent to those of skill in the art.

The capsid and other fragments of the invention can be readily utilized in a variety of vector systems and host cells. Such fragments may be used alone, in combination with other AAV sequences or fragments, or in combination with elements from other AAV or non-AAV viral sequences. In one particularly desirable embodiment, a vector contains the AAV cap and/or rep sequences of the invention.

The AAV sequences and fragments thereof are useful in production of rAAV, and are also useful as antisense delivery vectors, gene therapy vectors, or vaccine vectors. The invention further provides nucleic acid molecules, gene delivery vectors, and host cells which contain the AAV sequences of the invention.

Suitable fragments can be determined using the information provided herein.

As described herein, the vectors of the invention containing the AAV capsid proteins of the invention are particularly well suited for use in applications in which the neutralizing antibodies diminish the effectiveness of other AAV serotype based vectors, as well as other viral vectors. The rAAV vectors of the invention are particularly advantageous in rAAV readministration and repeat gene therapy.

These and other embodiments and advantages of the invention are described in more detail below.

A. AAV Serotype 9/hu14 Sequences

The invention provides the nucleic acid sequences and amino acids of a novel AAV, which is termed interchangeable herein as clone hu.14 (formerly termed 28.4) and huAAV9. As defined herein, novel serotype AAV9 refers to AAV having a capsid which generates antibodies which cross-react serologically with the capsid having the sequence of hu. 14 [SEQ ID NO: 123] and which antibodies do not cross-react serologically with antibodies generated to the capsids of any of AAV1, AAV2, AAV3, AAV4, AAV5, AAV6, AAV7 or AAV8.

1. Nucleic Acid Sequences

The AAV9 nucleic acid sequences of the invention include the DNA sequences of SEQ ID NO: 3, which consists of 2211 nucleotides.

The nucleic acid sequences of the invention further encompass the strand which is complementary to SEQ ID NO: 3, as well as the RNA and cDNA sequences corresponding to SEQ ID NO: 3, and its complementary strand. Also included in the nucleic acid sequences of the invention are natural variants and engineered modifications of SEQ ID NO: 3 and its complementary strand. Such modifications include, for example, labels that are known in the art, methylation, and substitution of one or more of the naturally occurring nucleotides with a degenerate nucleotide.

Further included in this invention are nucleic acid sequences which are greater than about 90%, more preferably at least about 95%, and most preferably at least about 98 to 99%, identical or homologous to SEQ ID NO: 3.

Also included within the invention are fragments of SEQ ID NO: 3, its complementary strand, and cDNA and RNA complementary thereto. Suitable fragments are at least 15 nucleotides in length, and encompass functional fragments, i.e., fragments which are of biological interest. Such fragments include the sequences encoding the three variable proteins (vp) of the AAV9/HU.14 capsid which are alternative splice variants: vp1 [nt 1 to 2211 of SEQ ID NO:3]; vp2 [about nt 411 to 2211 of SEQ ID NO:3]; and vp 3 [about nt 609 to 2211 of SEQ ID NO:3]. Other suitable fragments of SEQ ID NO: 3, include the fragment which contains the start codon for the AAV9/HU.14 capsid protein, and the fragments encoding the hypervariable regions of the vp1 capsid protein, which are described herein.

In addition to including the nucleic acid sequences provided in the figures and Sequence Listing, the present invention includes nucleic acid molecules and sequences which are designed to express the amino acid sequences, proteins and peptides of the AAV serotypes of the invention. Thus, the invention includes nucleic acid sequences which encode the following novel AAV amino acid sequences and artificial AAV serotypes generated using these sequences and/or unique fragments thereof.

As used herein, artificial AAV serotypes include, without limitation, AAVs with a non-naturally occurring capsid protein. Such an artificial capsid may be generated by any suitable technique, using a novel AAV sequence of the invention (e.g., a fragment of a vp1 capsid protein) in combination with heterologous sequences which may be obtained from another AAV serotype (known or novel), non-contiguous portions of the same AAV serotype, from a non-AAV viral source, or from a non-viral source. An artificial AAV serotype may be, without limitation, a chimeric AAV capsid, a recombinant AAV capsid, or a "humanized" AAV capsid.

2. HU.14/AAV9 Amino Acid Sequences, Proteins and Peptides

The invention further provides proteins and fragments thereof which are encoded by the hu.14/AAV9 nucleic acids of the invention, and hu.14/AAV9 proteins and fragments which are generated by other methods. As used herein, these proteins include the assembled capsid. The invention further encompasses AAV serotypes generated using sequences of the novel AAV serotype of the invention, which are generated using synthetic, recombinant or other techniques known to those of skill in the art. The invention is not limited to novel AAV amino acid sequences, peptides and proteins expressed from the novel AAV nucleic acid sequences of the invention, but encompasses amino acid sequences, peptides and proteins generated by other methods known in the art, including, e.g., by chemical synthesis, by other synthetic techniques, or by other methods. The sequences of any of the AAV capsids provided herein can be readily generated using a variety of techniques.

Suitable production techniques are well known to those of skill in the art. See, e.g., Sambrook et al, Molecular Cloning: A Laboratory Manual, Cold Spring Harbor Press (Cold Spring Harbor, N.Y.). Alternatively, peptides can also be synthesized by the well-known solid phase peptide synthesis methods (Merrifield . *J. Am. Chem. Soc.,* 85:2149 (1962); Stewart and Young, Solid Phase Peptide Synthesis (Freeman, San Francisco, 1969) pp. 27-62). These and other suitable production methods are within the knowledge of those of skill in the art and are not a limitation of the present invention.

Figure 2B:
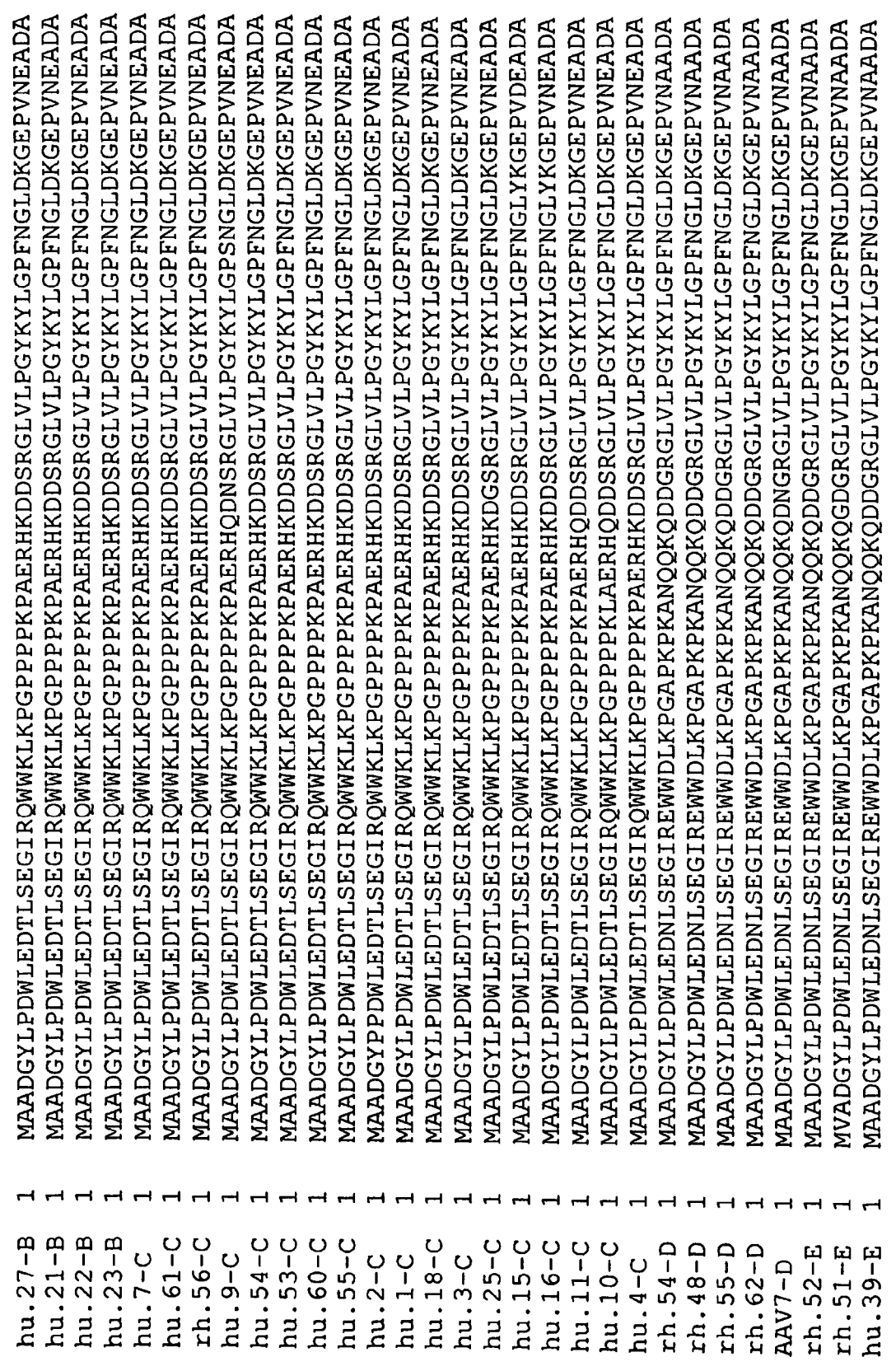
Figure 2C:
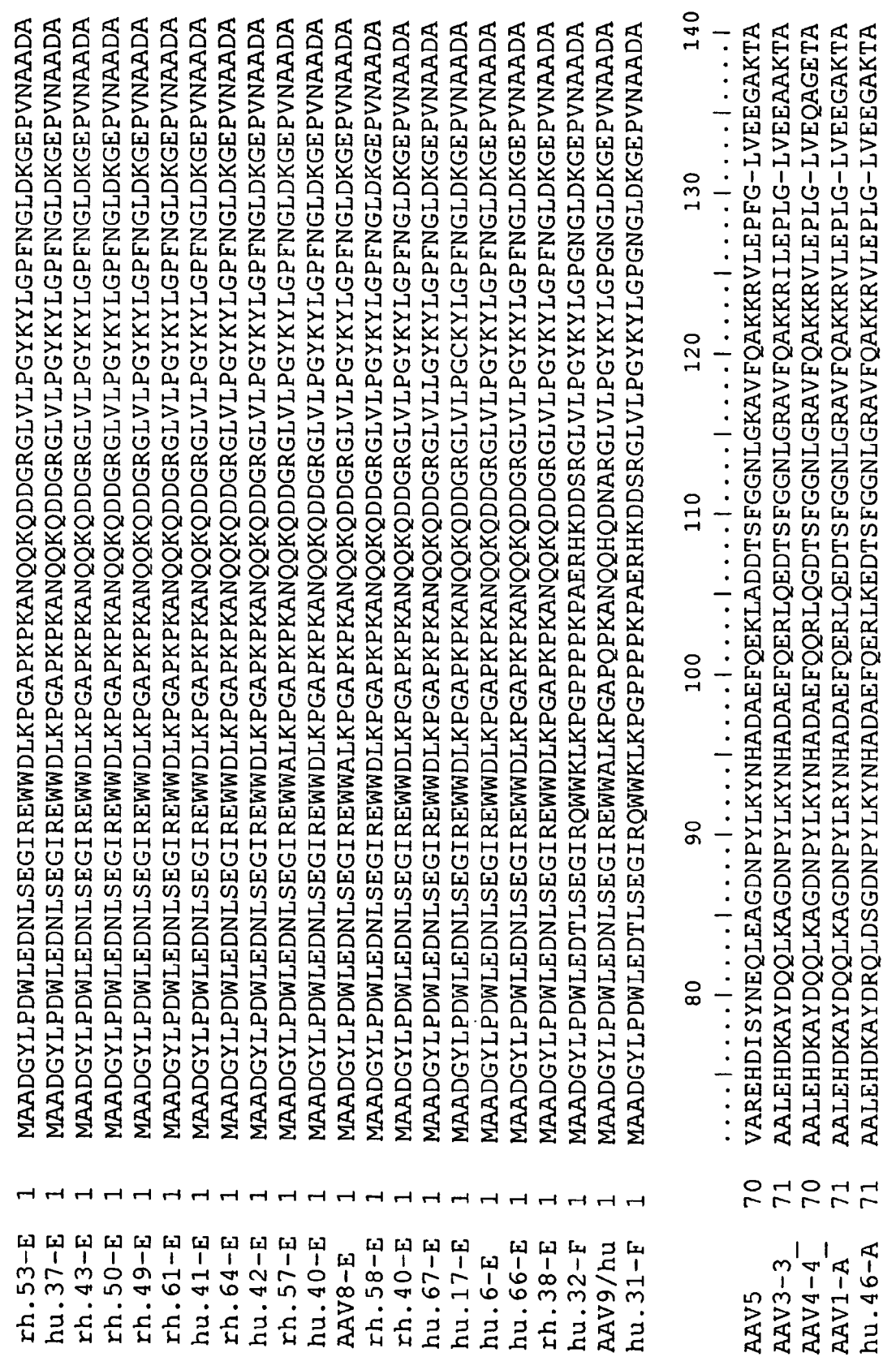

Particularly desirable proteins include the AAV capsid proteins. which are encoded by the nucleotide sequences identified above. The AAV capsid is composed of three proteins, vp1, vp2 and vp3, which are alternative splice variants. The full-length sequence provided in FIG. 2 is that of vp1. The AAV9/HU.14 capsid proteins include vp1 [amino acids (aa) 1 to 736 of SEQ ID NO: 123 ], vp2 [about aa 138 to 736 of SEQ ID NO: 123], vp3 [about aa 203 to 736 of SEQ ID NO: 123], and functional fragments thereof. Other desirable fragments of the capsid protein include the constant and variable regions, located between hypervariable regions (HVR). Other desirable fragments of the capsid protein include the HVR themselves.

An algorithm developed to determine areas of sequence divergence in AAV2 has yielded 12 hypervariable regions (HVR) of which 5 overlap or are part of the four previously described variable regions. [Chiorini et al, *J. Virol,* 73:1309-19 (1999); Rutledge et al, *J. Virol.,* 72:309-319] Using this algorithm and/or the alignment techniques described herein, the HVR of the novel AAV serotypes are determined. For example, the HVR are located as follows: HVR1, aa 146-152; HVR2. aa 182-186; HVR3, aa 262-264; HVR4, aa 381-383; HVR5, aa 450-474; HVR6, aa 490-495; HVR7, aa 500-504; HVR8, aa 514-522; HVR9, aa 534-555; HVR10, aa 581-594; HVR11, aa 658-667; and HVR12, aa 705-719 [the numbering system is based on an alignment which uses the AAV2 vp1 as a point of reference]. Using the alignment provided herein performed using the Clustal X program at default settings, or using other commercially or publicly available alignment programs at default settings such as are described herein, one of skill in the art can readily determine corresponding fragments of the novel AAV capsids of the invention.

Still other desirable fragments of the AAV9/HU.14 capsid protein include amino acids 1 to 184 of SEQ ID NO: 123, amino acids 199 to 259; amino acids 274 to 446; amino acids 603 to 659; amino acids 670 to 706; amino acids 724 to 736 of SEQ ID NO: 123; aa 185-198; aa 260-273; aa447-477; aa495-602; aa660-669; and aa707-723. Additionally, examples of other suitable fragments of AAV capsids include. with respect to the numbering of AAV9 [SEQ ID NO: 123], aa 24-42, aa 25-28; aa 81-85; aa133-165; aa 134-165; aa 137-143; aa 154-156; aa 194-208; aa 261-274; aa 262-274; aa 171-173; aa 413-417; aa 449-478; aa 494-525; aa 534-571;aa 581-601; aa 660-671; aa 709-723. Using the alignment provided herein performed using the Clustal X program at default settings, or using other commercially or publicly available alignment programs at default settings, one of skill in the art can readily determine corresponding fragments of the novel AAV capsids of the invention.

Still other desirable AAV9/HU.14 proteins include the rep proteins include rep68/78 and rep40/52.

Suitably, fragments are at least 8 amino acids in length. However, fragments of other desired lengths may be readily utilized. Such fragments may be produced recombinantly or by other suitable means, e.g., chemical synthesis.

The invention further provides other AAV9/HU.14 sequences which are identified using the sequence information provided herein. For example, given the AAV9/HU.14 sequences provided herein, infectious AAV9/HU.14 may be isolated using genome walking technology (Siebert et al., 1995, *Nucleic Acid Research,* 23:1087-1088, Friezner-Degen et al., 1986, *J Biol. Chem.* 261:6972-6985, BD Biosciences Clontech, Palo Alto, Calif.). Genome walking is particularly well suited for identifying and isolating the sequences adjacent to the novel sequences identified according to the method of the invention. This technique is also useful for isolating inverted terminal repeat (ITRs) of the novel AAV9/HU.14 serotype, based upon the novel AAV capsid and rep sequences provided herein.

The sequences, proteins, and fragments of the invention may be produced by any suitable means, including recombinant production, chemical synthesis, or other synthetic means. Such production methods are within the knowledge of those of skill in the art and are not a limitation of the present invention.

III. Production of rAAV with Novel AAV Capsids

The invention encompasses novel AAV capsid sequences of which are free of DNA and/or cellular material with these viruses are associated in nature. To avoid repeating all of the novel AAV capsids provided herein, reference is made throughout this and the following sections to the hu.14/AAV9 capsid. However, it should be appreciated that the other novel AAV capsid sequences of the invention can be used in a similar manner.

In another aspect, the present invention provides molecules that utilize the novel AAV sequences of the invention, including fragments thereof, for production of molecules useful in delivery of a heterologous gene or other nucleic acid sequences to a target cell.

In another aspect, the present invention provides molecules that utilize the AAV sequences of the invention, including fragments thereof, for production of viral vectors useful in delivery of a heterologous gene or other nucleic acid sequences to a target cell.

The molecules of the invention which contain AAV sequences include any genetic element (vector) which may be delivered to a host cell, e.g., naked DNA. a plasmid, phage, transposon, cosmid, episome, a protein in a non-viral delivery vehicle (e.g., a lipid-based carrier), virus, etc., which transfers the sequences carried thereon. The selected vector may be delivered by any suitable method, including transfection. electroporation, liposome delivery, membrane fusion techniques, high velocity DNA-coated pellets, viral infection and protoplast fusion. The methods used to construct any embodiment of this invention are known to those with skill in nucleic acid manipulation and include genetic engineering, recombinant engineering, and synthetic techniques. See, e.g., Sambrook et al, Molecular Cloning: A Laboratory Manual, Cold Spring Harbor Press, Cold Spring Harbor, N.Y.

In one embodiment, the vectors of the invention contain, inter alia, sequences encoding an AAV capsid of the invention or a fragment thereof. In another embodiment. the vectors of the invention contain, at a minimum, sequences encoding an AAV rep protein or a fragment thereof. Optionally, vectors of the invention may contain both AAV cap and rep proteins. In vectors in which both AAV rep and cap are provided. the AAV rep and AAV cap sequences can originate from an AAV of the same lade. Alternatively, the present invention provides vectors in which the rep sequences are from an AAV source which differs from that which is providing the cap sequences. In one embodiment, the rep and cap sequences are expressed from separate sources (e.g., separate vectors, or a host cell and a vector). In another embodiment, these rep sequences are fused in frame to cap sequences of a different AAV source to form a chimeric AAV vector. Optionally, the vectors of the invention are vectors packaged in an AAV capsid of the invention. These vectors and other vectors described herein can further contain a minigene comprising a selected transgene which is flanked by AAV 5' ITR and AAV 3' ITR.

Thus, in one embodiment, the vectors described herein contain nucleic acid sequences encoding an intact AAV capsid which may be from a single AAV sequence (e.g., AAV9/HU.14). Such a capsid may comprise amino acids 1 to 736 of SEQ ID NO:123. Alternatively, these vectors contain sequences encoding artificial capsids which contain one or more fragments of the AAV9/HU.14 capsid fused to heterologous AAV or non-AAV capsid proteins (or fragments thereof). These artificial capsid proteins are selected from non-contiguous portions of the AAV9/HU.14 capsid or from capsids of other AAVs. For example, a rAAV may have a capsid protein comprising one or more of the AAV9/HU.14 capsid regions selected from the vp2 and/or vp3, or from vp 1, or fragments thereof selected from amino acids 1 to 184, amino acids 199 to 259; amino acids 274 to 446; amino acids 603 to 659; amino acids 670 to 706; amino acids 724 to 738 of the AAV9/HU.14 capsid, SEQ ID NO: 123. In another example. it may be desirable to alter the start codon of the vp3 protein to GTG. Alternatively, the rAAV may contain one or more of the AAV serotype 9 capsid protein hypervariable regions which are identified herein, or other fragment including, without limitation, aa 185-198; aa 260-273; aa447-477; aa495-602; aa660-669; and aa707-723 of the AAV9/HU.14 capsid. See, SEQ ID NO: 123. These modifications may be to increase expression, yield, and/or to improve purification in the selected expression systems, or for another desired purpose (e.g., to change tropism or alter neutralizing antibody epitopes).

The vectors described herein, e.g., a plasmid, are useful for a variety of purposes, but are particularly well suited for use in production of a rAAV containing a capsid comprising AAV sequences or a fragment thereof. These vectors including rAAV. their elements, construction, and uses are described in detail herein.

In one aspect, the invention provides a method of generating a recombinant adeno-associated virus (AAV) having an AAV serotype 9 capsid, or a portion thereof. Such a method involves culturing a host cell which contains a nucleic acid sequence encoding an AAV serotype 9 capsid protein, or fragment thereof, as defined herein; a functional rep gene; a minigene composed of, at a minimum, AAV inverted terminal repeats (ITRs) and a transgene; and sufficient helper functions to permit packaging of the minigene into the AAV9/HU.14 capsid protein.

The components required to be cultured in the host cell to package an AAV minigene in an AAV capsid may be provided to the host cell in trans. Alternatively, any one or more of the required components (e.g., minigene, rep sequences, cap sequences, and/or helper functions) may be provided by a stable host cell which has been engineered to contain one or more of the required components using methods known to those of skill in the art. Most suitably, such a stable host cell will contain the required component(s) under the control of an inducible promoter. However, the required component(s) may be under the control of a constitutive promoter. Examples of suitable inducible and constitutive promoters are provided herein, in the discussion of regulatory elements suitable for use with the transgene. In still another alternative, a selected stable host cell may contain selected component(s) under the control of a constitutive promoter and other selected component(s) under the control of one or more inducible promoters. For example, a stable host cell may be generated which is derived from 293 cells (which contain E1 helper functions under the control of a constitutive promoter), but which contains the rep and/or cap proteins under the control of inducible promoters. Still other stable host cells may be generated by one of skill in the art.

The minigene, rep sequences, cap sequences, and helper functions required for producing the rAAV of the invention may be delivered to the packaging host cell in the form of any genetic element which transfer the sequences carried thereon. The selected genetic element may be delivered by any suitable method, including those described herein. The methods used to construct any embodiment of this invention are known to those with skill in nucleic acid manipulation and include genetic engineering, recombinant engineering, and synthetic techniques. See, e.g., Sambrook et al, Molecular Cloning: A Laboratory Manual, Cold Spring Harbor Press, Cold Spring Harbor, N.Y.

Similarly, methods of generating rAAV virions are well known and the selection of a suitable method is not a limitation on the present invention. See, e.g., K. Fisher et al, *J. Virol.*, 70:520-532 (1993) and U.S. Pat. No. 5,478,745.

Unless otherwise specified, the AAV ITRs, and other selected AAV components described herein, may be readily selected from among any AAV, including, without limitation, AAV1, AAV2, AAV3, AAV4, AAV5, AAV6, AAV7, AAV9 and one of the other novel AAV sequences of the invention. These ITRs or other AAV components may be readily isolated using techniques available to those of skill in the art from an AAV sequence. Such AAV may be isolated or obtained from academic, commercial, or public sources (e.g., the American Type Culture Collection, Manassas, Va.). Alternatively, the AAV sequences may be obtained through synthetic or other suitable means by reference to published sequences such as are available in the literature or in databases such as, e.g., GenBank®, PubMed®, or the like.

A. The Minigene

The minigene is composed of, at a minimum, a transgene and its regulatory sequences, and 5' and 3' AAV inverted terminal repeats (ITRs). In one desirable embodiment, the ITRs of AAV serotype 2 are used. However, ITRs from other suitable sources may be selected. It is this minigene that is packaged into a capsid protein and delivered to a selected host cell.

1. The Transgene

The transgene is a nucleic acid sequence, heterologous to the vector sequences flanking the transgene, which encodes a polypeptide, protein, or other product, of interest. The nucleic acid coding sequence is operatively linked to regulatory components in a manner which permits transgene transcription, translation, and/or expression in a host cell.

The composition of the transgene sequence will depend upon the use to which the resulting vector will be put. For example, one type of transgene sequence includes a reporter sequence, which upon expression produces a detectable signal. Such reporter sequences include, without limitation, DNA sequences encoding β-lactamase, β-galactosidase (LacZ), alkaline phosphatase, thymidine kinase, green fluorescent protein (GFP), enhanced GFP (EGFP), chloramphenicol acetyltransferase (CAT), luciferase, membrane bound proteins including, for example, CD2, CD4, CD8, the influenza hemagglutinin protein, and others well known in the art, to which high affinity antibodies directed thereto exist or can be produced by conventional means, and fusion proteins comprising a membrane bound protein appropriately fused to an antigen tag domain from, among others, hemagglutinin or Myc.

These coding sequences, when associated with regulatory elements which drive their expression, provide signals detectable by conventional means, including enzymatic, radiographic, colorimetric, fluorescence or other spectrographic assays, fluorescent activating cell sorting assays and immunological assays, including enzyme linked immunosorbent assay (ELISA), radioimmunoassay (RIA) and immunohistochemistry. For example, where the marker sequence is the LacZ gene. the presence of the vector carrying the signal is detected by assays for beta-galactosidase activity. Where the transgene is green fluorescent protein or luciferase, the vector carrying the signal may be measured visually by color or light production in a luminometer.

However, desirably, the transgene is a non-marker sequence encoding a product which is useful in biology and medicine, such as proteins, peptides, RNA, enzymes, dominant negative mutants, or catalytic RNAs. Desirable RNA molecules include tRNA, dsRNA, ribosomal RNA, catalytic RNAs, siRNA, small hairpin RNA, trans-splicing RNA, and antisense RNAs. One example of a useful RNA sequence is a sequence which inhibits or extinguishes expression of a targeted nucleic acid sequence in the treated animal. Typically, suitable target sequences include oncologic targets and viral diseases. See, for examples of such targets the oncologic targets and viruses identified below in the section relating to immunogens.

The transgene may be used to correct or ameliorate gene deficiencies, which may include deficiencies in which normal genes are expressed at less than normal levels or deficiencies in which the functional gene product is not expressed. Alternatively, the transgene may provide a product to a cell which is not natively expressed in the cell type or in the host. A preferred type of transgene sequence encodes a therapeutic protein or polypeptide which is expressed in a host cell. The invention further includes using multiple transgenes. In certain situations, a different transgene may be used to encode each subunit of a protein, or to encode different peptides or proteins. This is desirable when the size of the DNA encoding the protein subunit is large, e.g. for an immunoglobulin, the platelet-derived growth factor, or a dystrophin protein. In order for the cell to produce the multi-subunit protein, a cell is infected with the recombinant virus containing each of the different subunits. Alternatively, different subunits of a protein may be encoded by the same transgene. In this case, a single transgene includes the DNA encoding each of the subunits, with the DNA for each subunit separated by an internal ribozyme entry site (IRES). This is desirable when the size of the DNA encoding each of the subunits is small, e.g., the total size of the DNA encoding the subunits and the IRES is less than five kilobases. As an alternative to an IRES, the DNA may be separated by sequences encoding a 2A peptide, which self-cleaves in a post-translational event. See, e.g., M. L. Donnelly, et al, *J. Gen. Virol.*, 78(Pt 1):13-21 (Jan 1997); Furler, S., et al, Gene Ther., 8(11):864-873 (June 2001); Klump H., et al., *Gene Ther.*, 8(10):811-817 (May 2001). This 2A peptide is significantly smaller than an IRES, making it well suited for use when space is a limiting factor. More often, when the transgene is large, consists of multi-subunits, or two transgenes are co-delivered, rAAV carrying the desired transgene(s) or subunits are co-administered to allow them to concatamerize in vivo to form a single vector genome. In such an embodiment, a first AAV may carry an expression cassette which expresses a single transgene and a second AAV may carry an expression cassette which expresses a different transgene for co-expression in the host cell. However, the selected transgene may encode any biologically active product or other product, e.g., a product desirable for study.

Suitable transgenes may be readily selected by one of skill in the art. The selection of the transgene is not considered to be a limitation of this invention.

2. Regulatory Elements

In addition to the major elements identified above for the minigene, the vector also includes conventional control elements which are operably linked to the transgene in a manner which permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest.

Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. A great number of expression control sequences, including promoters which are native, constitutive, inducible and/or tissue-specific, are known in the art and may be utilized.

Examples of constitutive promoters include, without limitation, the retroviral Rous sarcoma virus (RSV) LTR promoter (optionally with the RSV enhancer), the cytomegalovirus (CMV) promoter (optionally with the CMV enhancer) [see, e.g., Boshart et al, *Cell*, 41:521-530 (1985)], the SV40 promoter, the dihydrofolate reductase promoter, the β-actin promoter, the phosphoglycerol kinase (PGK) promoter, and the EF1 promoter [Invitrogen]. Inducible promoters allow regulation of gene expression and can be regulated by exogenously supplied compounds. environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. Examples of inducible promoters regulated by exogenously supplied compounds, include, the zinc-inducible sheep metallothionine (MT) promoter, the dexamethasone (Dex)-inducible mouse mammary tumor virus (MMTV) promoter, the T7 polymerase promoter system [International Patent Publication No. WO 98/10088]; the ecdysone insect promoter [No et al, *Proc. Natl. Acad. Sci. USA*, 93:3346-3351 (1996)], the tetracycline-repressible system [Gossen et al, *Proc. Natl. Acad Sci. USA*, 89:5547-5551 (1992)], the tetracycline-inducible system [Gossen et al, *Science*, 268:1766-1769 (1995), see also Harvey et al, *Curr. Opin. Chem. BioL*, 2:512-518 (1998)], the RU486-inducible system [Wang et al, *Nat. Biotech.*, 15:239-243 (1997) and Wang et al, *Gene Ther.*, 4:432-441 (1997)] and the rapamycin-inducible system [Magari et al, *J. Clin. Invest.*, 100:2865-2872 (1997)]. Other types of inducible promoters which may be useful in this context are those which are regulated by a specific physiological state, e.g., temperature, acute phase, a particular differentiation state of the cell, or in replicating cells only.

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

Another embodiment of the transgene includes a gene operably linked to a tissue-specific promoter. For instance, if expression in skeletal muscle is desired, a promoter active in muscle should be used. These include the promoters from genes encoding skeletal P-actin, myosin light chain 2A, dystrophin, muscle creatine kinase, as well as synthetic muscle promoters with activities higher than naturally-occurring promoters (see Li et al., *Nat. Biotech.*, 17:241-245 (1999)). Examples of promoters that are tissue-specific are known for liver (albumin, Miyatake et al., *J. Virol.*, 71:5124-32 (1997); hepatitis B virus core promoter, Sandig et al., *Gene Ther.*, 3:1002-9 (1996); alpha-fetoprotein (AFP), Arbuthnot et al., *Hum. Gene Ther.*, 7:1503-14 (1996)), bone osteocalcin (Stein el al., *Mol. Biol. Rep.*, 24:185-96 (1997)); bone sialoprotein (Chen et aL, *J. Bone Miner. Res.*, 11:654-64 (1996)), lymphocytes (CD2, Hansal et al., *J. Immunol.*, 161:1063-8 (1998); immunoglobulin heavy chain; T cell receptor chain), neuronal such as neuron-specific enolase (NSE) promoter (Andersen et al., *Cell. Mol. Neurobiol.*, 13:503-15 (1993)), neurofilament light-chain gene (Piccioli et al., *Proc. Natl. Acad Sci. USA*, 88:5611-5 (1991)), and the neuron-specific vgf gene (Piccioli et al., *Neuron*, 15:373-84 (1995)), among others.

Optionally, plasmids carrying therapeutically useful transgenes may also include selectable markers or reporter genes may include sequences encoding geneticin, hygromicin or purimycin resistance, among others. Such selectable reporters or marker genes (preferably located outside the viral genome to be rescued by the method of the invention) can be used to signal the presence of the plasmids in bacterial cells, such as ampicillin resistance. Other components of the plasmid may include an origin of replication. Selection of these and other promoters and vector elements are conventional and many such sequences are available [see, e.g., Sambrook et al, and references cited therein].

The combination of the transgene, promoter/enhancer, and 5' and 3' AAV ITRs is referred to as a "minigene" for ease of reference herein. Provided with the teachings of this invention, the design of such a minigene can be made by resort to conventional techniques.

3. Delivery of the Minigene to a Packaging Host Cell

The minigene can be carried on any suitable vector, e.g., a plasmid, which is delivered to a host cell. The plasmids useful in this invention may be engineered such that they are suitable for replication and, optionally, integration in prokaryotic cells, mammalian cells, or both. These plasmids (or other vectors carrying the 5' AAV ITR-heterologous molecule-3' AAV ITR) contain sequences permitting replication of the minigene in eukaryotes and/or prokaryotes and selection markers for these systems. Selectable markers or reporter genes may include sequences encoding geneticin, hygromicin or purimycin resistance, among others. The plasmids may also contain certain selectable reporters or marker genes that can be used to signal the presence of the vector in bacterial cells, such as ampicillin resistance. Other components of the plasmid may include an origin of replication and an amplicon, such as the amplicon system employing the Epstein Barr virus nuclear antigen. This amplicon system, or other similar amplicon components permit high copy episomal replication in the cells. Preferably, the molecule carrying the minigene is transfected into the cell, where it may exist transiently. Alternatively, the minigene (carrying the 5' AAV ITR-heterologous molecule-3' ITR) may be stably integrated into the genome of the host cell, either chromosomally or as an episome. In certain embodiments, the minigene may be present in multiple copies, optionally in head-to-head, head-to-tail, or tail-to-tail concatamers. Suitable transfection techniques are known and may readily be utilized to deliver the minigene to the host cell.

Generally, when delivering the vector comprising the minigene by transfection, the vector is delivered in an amount from about 5 μg to about 100 μg DNA, about 10 μg to about 50 μg DNA to about $1 \times 10^4$ cells to about $1 \times 10^{13}$ cells, or about $1 \times 10^5$ cells. However, the relative amounts of vector DNA to host cells may be adjusted, taking into consideration such factors as the selected vector, the delivery method and the host cells selected.

B. Rep and Cap Sequences

In addition to the minigene, the host cell contains the sequences which drive expression of a novel AAV capsid protein of the invention (or a capsid protein comprising a fragment thereof) in the host cell and rep sequences of the same source as the source of the AAV ITRs found in the minigene, or a cross-complementing source. The AAV cap and rep sequences may be independently obtained from an AAV source as described above and may be introduced into the host cell in any manner known to one in the art as described above. Additionally, when pseudotyping an AAV vector in (e.g., an AAV9/HU.14 capsid), the sequences encoding each of the essential rep proteins may be supplied by different AAV sources (e.g., AAV1, AAV2, AAV3, AAV4, AAV5, AAV6, AAV7, AAV8). For example, the rep78/68 sequences may be from AAV2, whereas the rep52/40 sequences may be from AAV8.

In one embodiment, the host cell stably contains the capsid protein under the control of a suitable promoter, such as those described above. Most desirably, in this embodiment, the capsid protein is expressed under the control of an inducible promoter. In another embodiment, the capsid protein is supplied to the host cell in trans.

When delivered to the host cell in trans, the capsid protein may be delivered via a plasmid which contains the sequences necessary to direct expression of the selected capsid protein in the host cell. Most desirably, when delivered to the host cell in trans, the plasmid carrying the capsid protein also carries other sequences required for packaging the rAAV, e.g., the rep sequences.

In another embodiment, the host cell stably contains the rep sequences under the control of a suitable promoter, such as those described above. Most desirably, in this embodiment, the essential rep proteins are expressed under the control of an inducible promoter. In another embodiment, the rep proteins are supplied to the host cell in trans. When delivered to the host cell in trans, the rep proteins may be delivered via a plasmid which contains the sequences necessary to direct expression of the selected rep proteins in the host cell. Most desirably, when delivered to the host cell in trans, the plasmid carrying the capsid protein also carries other sequences required for packaging the rAAV, e.g., the rep and cap sequences.

Thus, in one embodiment, the rep and cap sequences may be transfected into the host cell on a single nucleic acid molecule and exist stably in the cell as an episome. In another embodiment, the rep and cap sequences are stably integrated into the chromosome of the cell. Another embodiment has the rep and cap sequences transiently expressed in the host cell. For example, a useful nucleic acid molecule for such transfection comprises, from 5' to 3', a promoter, an optional spacer interposed between the promoter and the start site of the rep gene sequence, an AAV rep gene sequence, and an AAV cap gene sequence.

Optionally, the rep and/or cap sequences may be supplied on a vector that contains other DNA sequences that are to be introduced into the host cells.

For instance, the vector may contain the rAAV construct comprising the minigene. The vector may comprise one or more of the genes encoding the helper functions, e.g., the adenoviral proteins E1, E2a, and E4 ORF6, and the gene for VAI RNA.

Preferably, the promoter used in this construct may be any of the constitutive, inducible or native promoters known to one of skill in the art or as discussed above. In one embodiment, an AAV P5 promoter sequence is employed. The selection of the AAV to provide any of these sequences does not limit the invention.

In another preferred embodiment, the promoter for rep is an inducible promoter, such as are discussed above in connection with the transgene regulatory elements. One preferred promoter for rep expression is the T7 promoter. The vector comprising the rep gene regulated by the T7 promoter and the cap gene, is transfected or transformed into a cell which either constitutively or inducibly expresses the T7 polymerase. See International Patent Publication No. WO 98/10088, published Mar. 12, 1998.

The spacer is an optional element in the design of the vector. The spacer is a DNA sequence interposed between the promoter and the rep gene ATG start site. The spacer may have any desired design; that is, it may be a random sequence of nucleotides, or alternatively, it may encode a gene product, such as a marker gene. The spacer may contain genes which typically incorporate start/stop and polyA sites. The spacer may be a non-coding DNA sequence from a prokaryote or eukaryote, a repetitive non-coding sequence, a coding sequence without transcriptional controls or a coding sequence with transcriptional controls. Two exemplary sources of spacer sequences are the phage ladder sequences or yeast ladder sequences, which are available commercially, e.g., from Gibco or Invitrogen, among others. The spacer may be of any size sufficient to reduce expression of the rep78 and rep68 gene products, leaving the rep52, rep40 and cap gene products expressed at normal levels. The length of the spacer may therefore range from about 10 bp to about 10.0 kbp, preferably in the range of about 100 bp to about 8.0 kbp. To reduce the possibility of recombination, the spacer is preferably less than 2 kbp in length; however, the invention is not so limited.

Although the molecule(s) providing rep and cap may exist in the host cell transiently (i.e., through transfection), it is preferred that one or both of the rep and cap proteins and the promoter(s) controlling their expression be stably expressed in the host cell, e.g., as an episome or by integration into the chromosome of the host cell. The methods employed for constructing embodiments of this invention are conventional genetic engineering or recombinant engineering techniques such as those described in the references above. While this specification provides illustrative examples of specific constructs, using the information provided herein, one of skill in the art may select and design other suitable constructs, using a choice of spacers, P5 promoters, and other elements, including at least one translational start and stop signal, and the optional addition of polyadenylation sites.

In another embodiment of this invention, the rep or cap protein may be provided stably by a host cell.

C. The Helper Functions

The packaging host cell also requires helper functions in order to package the rAAV of the invention. Optionally, these functions may be supplied by a herpesvirus. Most desirably, the necessary helper functions are each provided from a human or non-human primate adenovirus source, such as those described above and/or are available from a variety of sources, including the American Type Culture Collection (ATCC), Manassas, Va. (US). In one currently preferred embodiment, the host cell is provided with and/or contains an E1a gene product, an E1b gene product, an E2a gene product, and/or an E4 ORF6 gene product. The host cell may contain other adenoviral genes such as VAI RNA, but these genes are not required. In a preferred embodiment, no other adenovirus genes or gene functions are present in the host cell.

By "adenoviral DNA which expresses the E1a gene product", it is meant any adenovirus sequence encoding E1a or any functional E1a portion. Adenoviral DNA which expresses the E2a gene product and adenoviral DNA which expresses the E4ORF6 gene products are defined similarly. Also included are any alleles or other modifications of the adenoviral gene or functional portion thereof. Such modifications may be deliberately introduced by resort to conventional genetic engineering or mutagenic techniques to enhance the adenoviral function in some manner, as well as naturally occurring allelic variants thereof. Such modifications and methods for manipulating DNA to achieve these adenovirus gene functions are known to those of skill in the art.

The adenovirus E1a, E1b, E2a, and/or E4ORF6 gene products, as well as any other desired helper functions, can be provided using any means that allows their expression in a cell. Each of the sequences encoding these products may be on a separate vector, or one or more genes may be on the same vector. The vector may be any vector known in the art or disclosed above, including plasmids, cosmids and viruses. Introduction into the host cell of the vector may be achieved by any means known in the art or as disclosed above, including transfection, infection, electroporation, liposome delivery, membrane fusion techniques, high velocity DNA-coated pellets, viral infection and protoplast fusion, among others. One or more of the adenoviral genes may be stably integrated into the genome of the host cell, stably expressed as episomes, or expressed transiently. The gene products may all be expressed transiently, on an episome or stably integrated, or some of the gene products may be expressed stably while others are expressed transiently. Furthermore, the promoters for each of the adenoviral genes may be selected independently from a constitutive promoter, an inducible promoter or a native adenoviral promoter. The promoters may be regulated by a specific physiological state of the organism or cell (i.e., by the differentiation state or in replicating or quiescent cells) or by exogenously added factors, for example.

D. Host Cells And Packaging Cell Lines

The host cell itself may be selected from any biological organism, including prokaryotic (e.g., bacterial) cells, and eukaryotic cells, including, insect cells, yeast cells and mammalian cells. Particularly desirable host cells are selected from among any mammalian species, including, without limitation, cells such as A549, WEH1, 3T3, 10T1/2, BHK, MDCK, COS 1, COS 7, BSC 1, BSC 40, BMT 10, VERO. W138, HeLa, 293 cells (which express functional adenoviral E1), Saos, C2C12, L cells, HT1080, HepG2 and primary fibroblast, hepatocyte and myoblast cells derived from mammals including human, monkey, mouse, rat, rabbit, and hamster. The selection of the mammalian species providing the cells is not a limitation of this invention; nor is the type of mammalian cell, i.e., fibroblast, hepatocyte, tumor cell, etc. The requirements for the cell used is that it not carry any adenovirus gene other than E1, E2a and/or E4 ORF6; it not contain any other virus gene which could result in homologous recombination of a contaminating virus during the production of rAAV; and it is capable of infection or transfection of DNA and expression of the transfected DNA. In a preferred embodiment. the host cell is one that has rep and cap stably transfected in the cell.

One host cell useful in the present invention is a host cell stably transformed with the sequences encoding rep and cap, and which is transfected with the adenovirus E1, E2a, and E4ORF6 DNA and a construct carrying the minigene as described above. Stable rep and/or cap expressing cell lines, such as B-50 (International Patent Application Publication No. WO 99/15685), or those described in U.S. Pat No. 5,658, 785, may also be similarly employed. Another desirable host cell contains the minimum adenoviral DNA which is sufficient to express E4 ORF6. Yet other cell lines can be constructed using the novel AAV9 cap sequences of the invention.

The preparation of a host cell according to this invention involves techniques such as assembly of selected DNA sequences. This assembly may be accomplished utilizing conventional techniques. Such techniques include cDNA and genomic cloning, which are well known and are described in Sambrook et al., cited above, use of overlapping oligonucleotide sequences of the adenovirus and AAV genomes, combined with polymerase chain reaction, synthetic methods, and any other suitable methods which provide the desired nucleotide sequence.

Introduction of the molecules (as plasmids or viruses) into the host cell may also be accomplished using techniques known to the skilled artisan and as discussed throughout the specification. In preferred embodiment, standard transfection techniques are used, e.g., $CaPO_4$ transfection or electroporation, and/or infection by hybrid adenovirus/AAV vectors into cell lines such as the human embryonic kidney cell line HEK 293 (a human kidney cell line containing functional adenovirus E1 gene which provides trans-acting E1 proteins).

The AAV9/HU.14 based vectors which are generated by one of skill in the art are beneficial for gene delivery to selected host cells and gene therapy patients since no neutralization antibodies to AAV9/HU.14 have been found in the human population. One of skill in the art may readily prepare other rAAV viral vectors containing the AAV9/HU.14 capsid proteins provided herein using a variety of techniques known to those of skill in the art. One may similarly prepare still other rAAV viral vectors containing AAV9/HU.14 sequence and AAV capsids from another source.

One of skill in the art will readily understand that the novel AAV sequences of the invention can be readily adapted for use in these and other viral vector systems for in vitro, ex vivo or in vivo gene delivery. Similarly, one of skill in the art can readily select other fragments of the AAV genome of the invention for use in a variety of rAAV and non-rAAV vector systems. Such vectors systems may include. e.g., lentiviruses, retroviruses, poxviruses, vaccinia viruses, and adenoviral system, among others. Selection of these vector systems is not a limitation of the present invention.

Thus, the invention further provides vectors generated using the nucleic acid and amino acid sequences of the novel AAV of the invention. Such vectors are useful for a variety of purposes, including for delivery of therapeutic molecules and for use in vaccine regimens. Particularly desirable for delivery of therapeutic molecules are recombinant AAV containing capsids of the novel AAV of the invention. These or other vector constructs containing novel AAV sequences of the invention may be used in vaccine regimens, e.g., for co-delivery of a cytokine, or for delivery of the immunogen itself.

IV. Recombinant Viruses and Uses therefor

Using the techniques described herein, one of skill in the art can generate a rAAV having a capsid of an AAV of the invention or having a capsid containing one or more fragments of an AAV of the invention. In one embodiment, a full-length capsid from a single AAV, e.g., hu.14/AAV9 [SEQ ID NO: 123] can be utilized. In another embodiment, a full-length capsid may be generated which contains one or more fragments of the novel AAV capsid of the invention fused in flame with sequences from another selected AAV, or from heterologous (i.e., non-contiguous) portions of the same AAV. For example, a rAAV may contain one or more of the novel hypervariable region sequences of AAV9/HU.14. Alternatively, the unique AAV sequences of the invention may be used in constructs containing other viral or non-viral sequences. Optionally a recombinant virus may carry AAV rep sequences encoding one or more of the AAV rep proteins.

A. Delivery of Viruses

In another aspect, the present invention provides a method for delivery of a transgene to a host which involves transfecting or infecting a selected host cell with a recombinant viral vector generated with the AAV9/HU.14 sequences (or functional fragments thereof) of the invention. Methods for delivery are well known to those of skill in the art and are not a limitation of the present invention.

In one desirable embodiment, the invention provides a method for AAV-mediated delivery of a transgene to a host. This method involves transfecting or infecting a selected host cell with a recombinant viral vector containing a selected transgene under the control of sequences that direct expression thereof and AAV9 capsid proteins.

Optionally, a sample from the host may be first assayed for the presence of antibodies to a selected AAV source (e.g., a serotype). A variety of assay formats for detecting neutralizing antibodies are well known to those of skill in the art. The selection of such an assay is not a limitation of the present invention. See, e.g., Fisher et al, *Nature Med.*, 3(3):306-312 (March 1997) and W. C. Manning et al, *Human Gene Therapy*, 9:477-485 (Mar. 1, 1998). The results of this assay may be used to determine which AAV vector containing capsid proteins of a particular source are preferred for delivery. e.g., by the absence of neutralizing antibodies specific for that capsid source.

In one aspect of this method, the delivery of vector with AAV capsid proteins of the invention may precede or follow delivery of a gene via a vector with a different AAV capsid protein. Thus, gene delivery via rAAV vectors may be used for repeat gene delivery to a selected host cell. Desirably, subsequently administered rAAV vectors carry the same transgene as the first rAAV vector, but the subsequently administered vectors contain capsid proteins of sources (and preferably different serotypes) which differ from the first vector. For example, if a first vector has AAV9/HU.14 capsid proteins, subsequently administered vectors may have capsid proteins selected from among the other AAV, optionally, from another serotype or from another clade.

Optionally, multiple rAAV vectors can be used lo deliver large transgenes or multiple transgenes by co-administration of rAAV vectors concatamerize in vivo to form a single vector genome. In such an embodiment, a first AAV may carry an expression cassette which expresses a single transgene (or a subunit thereof) and a second AAV may carry an expression cassette which expresses a second transgene (or a different subunit) for co-expression in the host cell. A first AAV may carry an expression cassette which is a first piece of a polycistronic construct (e.g., a promoter and transgene or subunit) and a second AAV may carry an expression cassette which is a second piece of a polycistronic construct (e.g., transgene or subunit and a polyA sequence). These two pieces of a polycistronic construct concatamerize in vivo to form a single vector genome that co-expresses the transgenes delivered by the first and second AAV. In such embodiments, the rAAV vector carrying the first expression cassette and the rAAV vector carrying the second expression cassette can be delivered in a single pharmaceutical composition. In other embodiments, the two or more rAAV vectors are delivered as separate pharmaceutical compositions which can be administered substantially simultaneously, or shortly before or after one another.

The above-described recombinant vectors may be delivered to host cells according to published methods. The rAAV, preferably suspended in a physiologically compatible carrier, may be administered to a human or non-human mammalian patient. Suitable carriers may be readily selected by one of skill in the art in view of the indication for which the transfer virus is directed. For example, one suitable carrier includes saline, which may be formulated with a variety of buffering solutions (e.g., phosphate buffered saline). Other exemplary carriers include sterile saline, lactose, sucrose, calcium phosphate, gelatin, dextran, agar, pectin, peanut oil, sesame oil, and water. The selection of the carrier is not a limitation of the present invention.

Optionally, the compositions of the invention may contain, in addition to the rAAV and carrier(s), other conventional pharmaceutical ingredients, such as preservatives, or chemical stabilizers. Suitable exemplary preservatives include chlorobutanol, potassium sorbate, sorbic acid, sulfur dioxide, propyl gallate, the parabens. ethyl vanillin, glycerin, phenol, and parachlorophenol. Suitable chemical stabilizers include gelatin and albumin.

The vectors are administered in sufficient amounts to transfect the cells and to provide sufficient levels of gene transfer and expression to provide a therapeutic benefit without undue adverse effects, or with medically acceptable physiological effects, which can be determined by those skilled in the medical arts. Conventional and pharmaceutically acceptable routes of administration include, but are not limited to direct delivery to a desired organ (e.g., the liver (optionally via the hepatic artery) or lung), oral, inhalation, intranasal, intratracheal, intraarterial, intraocular, intravenous, intramuscular, subcutaneous, intradermal, and other parental routes of administration. Routes of administration may be combined, if desired.

Dosages of the viral vector will depend primarily on factors such as the condition being treated, the age, weight and health of the patient, and may thus vary among patients. For example, a therapeutically effective human dosage of the viral vector is generally in the range of from about 0.1 mL to about 100 mL of solution containing concentrations of from about $1 \times 10^9$ to $1 \times 10^{16}$ genomes virus vector. A preferred human dosage for delivery to large organs (e.g., liver, muscle, heart and lung) may be about $5 \times 10^{10}$ to $5 \times 10^{13}$ AAV genomes per 1 kg, at a volume of about 1 to 100 mL. A preferred dosage for delivery to eye is about $5 \times 10^9$ to $5 \times 10^{12}$ genome copies, at a volume of about 0.1 mL to 1 mL. The dosage will be adjusted to balance the therapeutic benefit against any side effects and such dosages may vary depending upon the therapeutic application for which the recombinant vector is employed. The levels of expression of the transgene can be monitored to determine the frequency of dosage resulting in viral vectors, preferably AAV vectors containing the minigene. Optionally, dosage regimens similar to those described for therapeutic purposes may be utilized for immunization using the compositions of the invention.

Examples of therapeutic products and immunogenic products for delivery by the AAV-containing vectors of the invention are provided below. These vectors may be used for a variety of therapeutic or vaccinal regimens, as described herein. Additionally, these vectors may be delivered in combination with one or more other vectors or active ingredients in a desired therapeutic and/or vaccinal regimen.

B. Therapeutic Transgenes

Useful therapeutic products encoded by the transgene include hormones and growth and differentiation factors including, without limitation, insulin, glucagon, growth hormone (GH), parathyroid hormone (PTH), growth hormone releasing factor (GRF), follicle stimulating hormone (FSH), luteinizing hormone (LH), human chorionic gonadotropin (hCG), vascular endothelial growth factor (VEGF), angiopoietins, angiostatin, granulocyte colony stimulating factor (GCSF), erythropoietin (EPO), connective tissue growth factor (CTGF), basic fibroblast growth factor (bFGF), acidic fibroblast growth factor (aFGF), epidermal growth factor (EGF), platelet-derived growth factor (PDGF), insulin growth factors I and II (IGF-I and IGF-II), any one of the transforming growth factor a superfamily, including TGF$\alpha$, activins, inhibins, or any of the bone morphogenic proteins (BMP) BMPs 1-15, any one of the heregluin/neuregulin/ARIA/neu differentiation factor (NDF) family of growth factors, nerve growth factor (NGF), brain-derived neurotrophic factor (BDNF), neurotrophins NT-3 and NT-4/5, ciliary neurotrophic factor (CNTF), glial cell line derived neurotrophic factor (GDNF), neurturin, agrin, any one of the family of semaphorins/collapsins, netrin-1 and netrin-2, hepatocyte growth factor (HGF), ephrins, noggin, sonic hedgehog and tyrosine hydroxylase.

Other useful transgene products include proteins that regulate the immune system including, without limitation, cytokines and lymphokines such as thrombopoietin (TPO), interleukins (IL) IL-1 through IL-25 (including, e.g., IL-2, IL-4, IL-12 and IL-18), monocyte chemoattractant protein, leukemia inhibitory factor, granulocyte-macrophage colony stimulating factor, Fas ligand, tumor necrosis factors $\alpha$ and $\beta$, interferons $\alpha$, $\beta$, and $\gamma$, stem cell factor, flk-2/flt3 ligand. Gene products produced by the immune system are also useful in the invention. These include, without limitations, immunoglobulins IgG, IgM, IgA, IgD and IgE, chimeric immunoglobulins, humanized antibodies, single chain antibodies, T cell receptors, chimeric T cell receptors, single chain T cell receptors, class I and class II MHC molecules, as well as engineered immunoglobulins and MHC molecules. Useful gene products also include complement regulatory proteins such as complement regulatory proteins, membrane cofactor protein (MCP), decay accelerating factor (DAF), CR1, CF2 and CD59.

Still other useful gene products include any one of the receptors for the hormones, growth factors, cytokines, lymphokines, regulatory proteins and immune system proteins. The invention encompasses receptors for cholesterol regulation and/or lipid modulation, including the low density lipoprotein (LDL) receptor, high density lipoprotein (HDL) receptor, the very low density lipoprotein (VLDL) receptor, and scavenger receptors. The invention also encompasses gene products such as members of the steroid hormone receptor superfamily including glucocorticoid receptors and estrogen receptors, Vitamin D receptors and other nuclear receptors. In addition, useful gene products include transcription factors such as jun,fos, max, mad, serum response factor (SRF), AP-1, AP2, myb, MyoD and myogenin, ETS-box containing proteins, TFE3, E2F, ATF1, ATF2, ATF3, ATF4, ZF5, NFAT, CREB, HNF-4, C/EBP, SP1, CCAAT-box binding proteins, interferon regulation factor (IRF-1), Wilms tumor protein, ETS-binding protein, STAT, GATA-box binding proteins, e.g., GATA-3, and the forkhead family of winged helix proteins.

Other useful gene products include, carbamoyl synthetase 1, ornithine transcarbamylase, arginosuccinate synthetase, arginosuccinate lyase, arginase, fumarylacetacetate hydrolase, phenylalanine hydroxylase, alpha-1 antitrypsin, glucose-6-phosphatase, porphobilinogen deaminase, cystathione beta-synthase, branched chain ketoacid decarboxylase, albumin, isovaleryl-coA dehydrogenase, propionyl CoA carboxylase, methyl malonyl CoA mutase, glutaryl CoA dehydrogenase, insulin, beta-glucosidase, pyruvate carboxylate, hepatic phosphorylase, phosphorylase kinase, glycine decarboxylase, H-protein, T-protein, a cystic fibrosis transmembrane regulator (CFTR) sequence, and a dystrophin gene product [e.g., a mini- or micro-dystrophin]. Still other useful gene products include enzymes such as may be useful in enzyme replacement therapy, which is useful in a variety of conditions resulting from deficient activity of enzyme. For example, enzymes that contain mannose-6-phosphate may be utilized in therapies for lysosomal storage diseases (e.g., a suitable gene includes that encoding $\beta$-glucuronidase (GUSB)).

Still other useful gene products include those used for treatment of hemophilia, including hemophilia B (including Factor IX) and hemophilia A (including Factor VIII and its variants, such as the light chain and heavy chain of the heterodimer and the B-deleted domain; U.S. Pat. Nos. 6,200,560 and 6,221,349). The Factor VIII gene codes for 2351 amino acids and the protein has six domains, designated from the amino to the terminal carboxy terminus as A1-A2-B-A3-C1-C2 [Wood et al, Nature, 312:330 (1984); Vehar et al., Nature 312:337 (1984); and Toole et al, Nature, 342:337 (1984)]. Human Factor VIII is processed within the cell to yield a heterodimer primarily comprising a heavy chain containing the A1l, A2 and B domains and a light chain containing the A3, C1 and C2 domains. Both the single chain polypeptide and the heterodimer circulate in the plasma as inactive precursors, until activated by thrombin cleavage between the A2 and B domains, which releases the B domain and results in a heavy chain consisting of the A1 and A2 domains. The B domain is deleted in the activated procoagulant form of the protein. Additionally, in the native protein, two polypeptide chains ("a" and "b"), flanking the B domain, are bound to a divalent calcium cation.

In some embodiments, the minigene comprises first 57 base pairs of the Factor VIII heavy chain which encodes the 10 amino acid signal sequence, as well as the human growth hormone (hGH) polyadenylation sequence. In alternative embodiments, the minigene further comprises the A1 and A2 domains, as well as 5 amino acids from the N-terminus of the B domain, and/or 85 amino acids of the C-terminus of the B domain, as well as the A3, C1 and C2 domains. In yet other embodiments, the nucleic acids encoding Factor VIII heavy chain and light chain are provided in a single minigene separated by 42 nucleic acids coding for 14 amino acids of the B domain [U.S. Pat. No. 6,200,560].

As used herein, a therapeutically effective amount is an amount of AAV vector that produces sufficient amounts of Factor VIII to decrease the time it takes for a subject's blood to clot. Generally, severe hemophiliacs having less than 1% of normal levels of Factor VIII have a whole blood clotting time of greater than 60 minutes as compared to approximately 10 minutes for non-hemophiliacs.

The present invention is not limited to any specific Factor VIII sequence. Many natural and recombinant forms of Factor VIII have been isolated and generated. Examples of naturally occurring and recombinant forms of Factor VII can be found in the patent and scientific literature including, U.S. Pat. No. 5,563,045, U.S. Pat. No. 5,451,521, U.S. Pat. No. 5,422,260, U.S. Pat. No. 5,004,803, U.S. Pat. No. 4,757,006, U.S. Pat. No. 5,661,008, U.S. Pat. No. 5,789,203, U.S. Pat. No. 5,681,746, U.S. Pat. No. 5,595,886, U.S. Pat. No. 5,045,455, U.S. Pat. No. 5,668,108, U.S. Pat. No. 5,633,150, U.S. Pat. No. 5,693,499, U.S. Pat. No. 5,587,310, U.S. Pat. No. 5,171,844, U.S. Pat. No. 5,149,637, U.S. Pat. No. 5,112,950, U.S. Pat. No. 4,886,876; International Patent Publication Nos. WO 94/11503, WO 87/07144, WO 92/16557, WO 91/09122, WO 97/03195, WO 96/21035, and WO 91/07490; European Patent Application Nos. EP 0 672 138, EP 0 270 618, EP 0 182 448, EP 0 162 067, EP 0 786 474, EP 0 533 862, EP 0 506 757, EP 0 874 057,EP 0 795 021, EP 0 670 332, EP 0 500 734, EP 0 232 112, and EP 0 160 457; Sanberg et al., XXth Int. Congress of the World Fed. Of Hemophilia (1992), and Lind et al., *Eur. J. Biochem.*, 232:19 (1995).

Nucleic acids sequences coding for the above-described Factor VII can be obtained using recombinant methods or by deriving the sequence from a vector known to include the same. Furthermore, the desired sequence can be isolated directly from cells and tissues containing the same, using standard techniques, such as phenol extraction and PCR of cDNA or genomic DNA [See, e.g., Sambrook et al]. Nucleotide sequences can also be produced synthetically, rather than cloned. The complete sequence can be assembled from overlapping oligonucleotides prepared by standard methods and assembled into a complete coding sequence [See, e.g., Edge, *Nature* 292:757 (1981); Nambari et al, *Science,* 223: 1299(1984); and Jay et al, *J. Biol. Chem.* 259:6311 (1984).

Furthermore, the invention is not limited to human Factor VIII. Indeed, it is intended that the present invention encompass Factor VII from animals other than humans, including but not limited to companion animals (e.g., canine, felines, and equines), livestock (e.g., bovines, caprines and ovines), laboratory animals, marine mammals, large cats, etc.

The AAV vectors may contain a nucleic acid coding for fragments of Factor VIII which is itself not biologically active, yet when administered into the subject improves or restores the blood clotting time. For example, as discussed above, the Factor VIII protein comprises two polypeptide chains: a heavy chain and a light chain separated by a B-domain which is cleaved during processing. As demonstrated by the present invention, co-tranducing recipient cells with the Factor VIII heavy and light chains leads to the expression of biologically active Factor VIII. Because most hemophiliacs contain a mutation or deletion in only one of the chains (e.g., heavy or light chain), it may be possible to administer only the chain defective in the patient to supply the other chain.

Other useful gene products include non-naturally occurring polypeptides, such as chimeric or hybrid polypeptides having a non-naturally occurring amino acid sequence containing insertions, deletions or amino acid substitutions. For example, single-chain engineered immunoglobulins could be useful in certain immunocompromised patients. Other types of non-naturally occurring gene sequences include antisense molecules and catalytic nucleic acids, such as ribozymes, which could be used to reduce overexpression of a target.

Reduction and/or modulation of expression of a gene is particularly desirable for treatment of hyperproliferative conditions characterized by hyperproliferating cells, as are cancers and psoriasis. Target polypeptides include those polypeptides which are produced exclusively or at higher levels in hyperproliferative cells as compared to normal cells. Target antigens include polypeptides encoded by oncogenes such as myb, myc, fyn, and the translocation gene bcr/abl, ras, src, P53, neu, trk and EGRF. In addition to oncogene products as target antigens, target polypeptides for anti-cancer treatments and protective regimens include variable regions of antibodies made by B cell lymphomas and variable regions of T cell receptors of T cell lymphomas which, in some embodiments, are also used as target antigens for autoimmune disease. Other tumor-associated polypeptides can be used as target polypeptides such as polypeptides which are found at higher levels in tumor cells including the polypeptide recognized by monoclonal antibody 17-1A and folate binding polypeptides.

Other suitable therapeutic polypeptides and proteins include those which may be useful for treating individuals suffering from autoimmune diseases and disorders by conferring a broad based protective immune response against targets that are associated with autoimmunity including cell receptors and cells which produce "self"-directed antibodies. T cell mediated autoimmune diseases include Rheumatoid arthritis (RA), multiple sclerosis (MS), Sjögren's syndrome, sarcoidosis, insulin dependent diabetes mellitus (IDDM), autoimmune thyroiditis, reactive arthritis, ankylosing spondylitis, scleroderma, polymyositis, dermatomyositis, psoriasis, vasculitis, Wegener's granulomatosis, Crohn's disease and ulcerative colitis. Each of these diseases is characterized by T cell receptors (TCRs) that bind to endogenous antigens and initiate the inflammatory cascade associated with autoimmune diseases.

C. Immunogenic Transgenes

Suitably, the AAV vectors of the invention avoid the generation of immune responses to the AAV sequences contained within the vector. However, these vectors may nonetheless be formulated in a manner that permits the expression of a transgene carried by the vectors to induce an immune response to a selected antigen. For example, in order to promote an immune response, the transgene may be expressed from a constitutive promoter, the vector can be adjuvanted as described herein, and/or the vector can be put into degenerating tissue.

Examples of suitable immunogenic transgenes include those selected from a variety of viral families. Examples of desirable viral families against which an immune response would be desirable include, the picornavirus family, which includes the genera rhinoviruses, which are responsible for about 50% of cases of the common cold; the genera enteroviruses, which include polioviruses, coxsackieviruses, echoviruses, and human enteroviruses such as hepatitis A virus; and the genera apthoviruses, which are responsible for foot and mouth diseases, primarily in non-human animals. Within the picornavirus family of viruses, target antigens include the VP1, VP2, VP3, VP4, and VPG. Other viral families include the astroviruses and the calcivirus family. The calcivirus family encompasses the Norwalk group of viruses, which are an important causative agent of epidemic gastroenteritis. Still another viral family desirable for use in targeting antigens for inducing immune responses in humans and non-human animals is the togavirus family, which includes the genera alphavirus, which include Sindbis viruses, RossRiver virus, and Venezuelan, Eastern & Western Equine encephalitis, and rubivirus, including Rubella virus. The flaviviridae family includes dengue, yellow fever, Japanese encephalitis, St. Louis encephalitis and tick borne encephalitis viruses. Other target antigens may be generated from the Hepatitis C or the coronavirus family, which includes a number of non-human viruses such as infectious bronchitis virus (poultry), porcine transmissible gastroenteric virus (pig), porcine hemagglutinatin encephalomyelitis virus (pig), feline infectious peritonitis virus (cat), feline enteric coronavirus (cat), canine coronavirus (dog), and human respiratory coronaviruses, which may cause the common cold and/or non-A, B or C hepatitis, and which include the putative cause of sudden acute respiratory syndrome (SARS). Within the coronavirus family, target antigens include the E1 (also called M or matrix protein), E2 (also called S or Spike protein), E3 (also called HE or hemagglutin-elterose) glycoprotein (not present in all coronaviruses), or N (nucleocapsid). Still other antigens may be targeted against the arterivirus family and the rhabdovirus family. The rhabdovirus family includes the genera vesiculovirus (e.g., Vesicular Stomatitis Virus), and the general lyssavirus (e.g., rabies). Within the rhabdovirus family, suitable antigens may be derived from the G protein or the N protein.

The family filoviridae, which includes hemorrhagic fever viruses such as Marburg and Ebola virus may be a suitable source of antigens. The paramyxovirus family includes parainfluenza Virus Type 1, parainfluenza Virus Type 3, bovine parainfluenza Virus Type 3, rubulavirus (mumps virus, parainfluenza Virus Type 2, parainfluenza virus Type 4, Newcastle disease virus (chickens), rinderpest, morbillivirus, which includes measles and canine distemper, and pneumovirus, which includes respiratory syncytial virus. The influenza virus is classified within the family orthomyxovirus and is a suitable source of antigen (e.g., the HA protein, the N1 protein). The bunyavirus family includes the genera bunyavirus (California encephalitis, La Crosse), phlebovirus (Rift Valley Fever), hantavirus (puremala is a hemahagin fever virus), nairovirus (Nairobi sheep disease) and various unassigned bungaviruses. The arenavirus family provides a source of antigens against LCM and Lassa fever virus. Another source of antigens is the bornavirus family. The reovirus family includes the genera reovirus, rotavirus (which causes acute gastroenteritis in children), orbiviruses, and cultivirus (Colorado Tick fever, Lebombo (humans), equine encephalosis, blue tongue). The retrovirus family includes the sub-family oncorivirinal which encompasses such human and veterinary diseases as feline leukemia virus, HTLVI and HTLVII, lentivirinal (which includes HIV, simian immunodeficiency virus, feline immunodeficiency virus, equine infectious anemia virus, and spumavirinal). The papovavirus family includes the sub-family polyomaviruses (BKU and JCU viruses) and the sub-family papillomavirus (associated with cancers or malignant progression of papilloma). The adenovirus family includes viruses (EX, AD7, ARD, O.B.) which cause respiratory disease and/or enteritis. The parvovirus family includes feline parvovirus (feline enteritis), feline panleucopeniavirus, canine parvovirus, and porcine parvovirus. The herpesvirus family includes the sub-family alphaherpesvirinae, which encompasses the genera simplexvirus (HSVI, HSVII), varicellovirus (pseudorabies, varicella zoster) and the sub-family betaherpesvirinae, which includes the genera cytomegalovirus (HCMV, muromegalovirus) and the sub-family gammaherpesvirinae, which includes the genera lymphocryptovirus, EBV (Burkitts lymphoma), human herpesviruses 6A, 6B and 7, Kaposi's sarcoma-associated herpesvirus and cercopithecine herpesvirus (B virus), infectious rhinotracheitis, Marek's disease virus, and rhadinovirus. The poxvirus family includes the sub-family chordopoxvirinae, which encompasses the genera orthopoxvirus (Variola major (Smallpox) and Vaccinia (Cowpox)), parapoxvirus, avipoxvirus, capripoxvirus, leporipoxvirus, suipoxvirus, and the sub-family entomopoxvirinae. The hepadnavirus family includes the Hepatitis B virus. One unclassified virus which may be suitable source of antigens is the Hepatitis delta virus, Hepatitis E virus, and prions. Another virus which is a source of antigens is Nipan Virus. Still other viral sources may include avian infectious bursal disease virus and porcine respiratory and reproductive syndrome virus. The alphavirus family includes equine arteritis virus and various Encephalitis viruses.

The present invention may also encompass immunogens which are useful to immunize a human or non-human animal against other pathogens including bacteria, fungi, parasitic microorganisms or multicellular parasites which infect human and non-human vertebrates, or from a cancer cell or tumor cell. Examples of bacterial pathogens include pathogenic gram-positive cocci include *pneumococci; staphylococci* (and the toxins produced thereby, e.g., enterotoxin B); and *streptococci*. Pathogenic gram-negative cocci include meningococcus; gonococcus. Pathogenic enteric gram-negative bacilli include enterobacteriaceae; pseudomonas, acinetobacteria and *eikenella*; melioidosis; *salmonella; shigella*; haemophilus; moraxella; *H. ducreyi* (which causes chancroid); brucella species (brucellosis); *Francisella tularensis* (which causes tularemia); Yersiniapestis (plague) and other yersinia (pasteurella); *streptobacillus* moniliformis and spirillum; Gram-positive bacilli include listeria monocytogenes; erysipelothrix rhusiopathiae; *Corynebacterium diphtheria* (diphtheria); cholera; *B. anthracis* (anthrax); donovanosis (granuloma inguinale); and bartonellosis. Diseases caused by pathogenic anaerobic bacteria include tetanus; botulism (*Clostridum botulinum* and its toxin); *Clostridium perfringens* and its epsilon toxin; other clostridia; tuberculosis; leprosy; and other mycobacteria. Pathogenic spirochetal diseases include syphilis; treponematoses: yaws, pinta and endemic syphilis; and leptospirosis. Other infections caused by higher pathogen bacteria and pathogenic fungi include glanders (*Burkholderia mallei*); actinomycosis; nocardiosis; cryptococcosis, blastomycosis, histoplasmosis and coccidioidomycosis; candidiasis, aspergillosis, and mucormycosis; sporotrichosis; paracoccidiodomycosis, petriellidiosis, torulopsosis, mycetoma and chromomycosis; and dermatophytosis. Rickettsial infections include Typhus fever, Rocky Mountain spotted fever, Q fever (*Coxiella burnetti*), and Rickettsialpox. Examples of mycoplasma and chlamydial infections include: mycoplasma pneumoniae; lymphogranuloma venereum; psittacosis; and perinatal chlamydial infections. Pathogenic eukaryotes encompass pathogenic protozoans and helminths and infections produced thereby include: amebiasis; malaria; leishmaniasis; trypanosomiasis; toxoplasmosis; *Pneumocystis carinii; Trichans; Toxoplasma gondii*; babesiosis; giardiasis; trichinosis; filariasis; schistosomiasis; nematodes; trematodes or flukes; and cestode (tapeworm) infections.

Many of these organisms and/or the toxins produced thereby have been identified by the Centers for Disease Control [(CDC), Department of Heath and Human Services, USA], as agents which have potential for use in biological attacks. For example, some of these biological agents, include, *Bacillus anthracis* (anthrax), *Clostridium botulinum* and its toxin (botulism), *Yersinia peslis* (plague), variola major (smallpox), *Francisella tularensis* (tularemia), and viral hemorrhagic fevers [filoviruses (e.g., Ebola, Marburg], and arenaviruses [e.g., Lassa, Machupo]), all of which are currently classified as Category A agents; *Coxiella burnetti* (Q fever); Brucella species (brucellosis), *Burkholderia mallei*

(glanders), *Burkholderia pseudomallei* (meloidosis), *Ricinus communis* and its toxin (ricin toxin), *Clostridium perfringens* and its toxin (epsilon toxin), *Staphylococcus* species and their toxins (enterotoxin B), *Chlamydia psittaci* (psittacosis), water safety threats (e.g., *Vibrio cholerae, Crytosporidium parvum*), Typhus fever (*Richettsia powazekii*), and viral encephalitis (alphaviruses, e.g., Venezuelan equine encephalitis; eastern equine encephalitis; western equine encephalitis); all of which are currently classified as Category B agents; and Nipan virus and hantaviruses, which are currently classified as Category C agents. In addition, other organisms, which are so classified or differently classified, may be identified and/or used for such a purpose in the future. It will be readily understood that the viral vectors and other constructs described herein are useful to deliver antigens from these organisms, viruses, their toxins or other by-products, which will prevent and/or treat infection or other adverse reactions with these biological agents.

Administration of the vectors of the invention to deliver immunogens against the variable region of the T cells elicit an immune response including CTLs to eliminate those T cells. In rheumatoid arthritis (RA), several specific variable regions of TCRs which are involved in the disease have been characterized. These TCRs include V-3, V-14, V-17 and V-17. Thus, delivery ofa nucleic acid sequence that encodes at least one of these polypeptides will elicit an immune response that will target T cells involved in RA. In multiple sclerosis (MS), several specific variable regions of TCRs which are involved in the disease have been characterized. These TCRs include V-7 and V-10. Thus, delivery of a nucleic acid sequence that encodes at least one of these polypeptides will elicit an immune response that will target T cells involved in MS. In scleroderma, several specific variable regions of TCRs which are involved in the disease have been characterized. These TCRs include V-6, V-8, V-14 and V-16, V-3C, V-7, V-14, V-15, V-16, V-28 and V-12. Thus, delivery of a nucleic acid molecule that encodes at least one of these polypeptides will elicit an immune response that will target T cells involved in scleroderma.

Thus, a rAAV-derived recombinant viral vector of the invention provides an efficient gene transfer vehicle which can deliver a selected transgene to a selected host cell in vivo or ex vivo even where the organism has neutralizing antibodies to one or more AAV sources. In one embodiment, the rAAV and the cells are mixed ex vivo; the infected cells are cultured using conventional methodologies; and the transduced cells are re-infused into the patient.

These compositions are particularly well suited to gene delivery for therapeutic purposes and for immunization, including inducing protective immunity. Further, the compositions of the invention may also be used for production of a desired gene product in vitro. For in vitro production, a desired product (e.g., a protein) may be obtained from a desired culture following transfection of host cells with a rAAV containing the molecule encoding the desired product and culturing the cell culture under conditions which permit expression. The expressed product may then be purified and isolated, as desired. Suitable techniques for transfection, cell culturing, purification, and isolation are known to those of skill in the art.

The following examples illustrate several aspects and embodiments of the invention.

EXAMPLE 1

Computational Analysis of Primate AAV Sequences

A. Collection of Primate Tissues

Sources of nonhuman primate tissues were described previously [N. Muzyczka, K. I. Berns, in *Fields Virology* D. M. Knipe, P. M. Howley, Eds. (Lippincott Williams & Wilkins, Philadelphia, 2001), vol. 2, pp. 2327-2359]. Human tissues were collected from either surgical procedures or postmortem examination or organ donors through two major national human tissue providers, Cooperative Human Tissue Network (CHTN) and National Disease Research Interchange (NDRI). Human tissues used for this study were comprised of 18 different tissue types that included colon, liver, lung, spleen, kidney, brain, small bowel, bone marrow, heart, lymph nodes, skeletal muscle, ovary, pancreas, stomach, esophagus, cervix, testis and prostate. The tissue samples came from a diverse group of individuals of different gender, races (Caucasian, African-American, Asian and Hispanic) and ages (23-83 years). Among 259 samples from 250 individuals analyzed, approximately 28% of tissues were associated with pathology.

B. Detection and Isolation of AAV sequences

Total cellular DNAs were extracted from human and nonhuman primate tissues as described previously [R. W. Atchison, et al., *Science* 194, 754-756 (1965)]. Molecular prevalence and tissue distribution of AAVs in humans were determined by either signature or full-length cap PCR using the primers and conditions that were similar to those used for the nonhuman primate analysis. The same PCR cloning strategy used for the isolation and characterization of an expanded family of AAVs in nonhuman primates was deployed in the isolation of AAVs from selected human tissues. Briefly, a 3.1 kb fragment containing a part of rep and full length cap sequence was amplified from tissue DNAs by PCR and Topo-cloned (Invitrogen). The human AAV clones were initially analyzed by restriction mapping to help identify diversity of AAV sequences, which were subsequently subjected to full sequence analysis by SeqWright (SeqWright, Houston, Tex.) with an accuracy of 99.9%. A total of 67 capsid clones isolated from human tissues were characterized (hu.1-hu.67). From nonhuman primate tissues, 86 cap clones were sequenced, among which 70 clones were from rhesus macaques, 6 clones from cynomologus macaques, 3 clones from pigtailed macaques, 2 clones from a baboon and 5 clones from a chimpanzee.

C. Analysis of AAV Sequences

From all contiguous sequences, AAV capsid viral protein (vp1) open reading frames (ORFs) were analyzed. The AAV capsid VP1 protein sequences were aligned with the ClustalX1.81™ program [H. D. Mayor, J. L. Melnick, *Nature* 210, 331-332 (1966)] and an in-frame DNA alignment was produced with the BioEdit™ [U. Bantel-Schaal, H. Zur Hausen, *Virology* 134, 52-63 (1984)] software package. Phylogenies were inferred with the MEGA™ v2.1 and the TreePuzzle™ package. Neighbor-Joining, Maximum Parsimony, and Maximum Likelihood [M. Nei, S. Kumar, *Molecular Evolution and Phylogenetics* (Oxford University Press, New York, 2000); H. A. Schmidt, K. Strimmer, M. Vingron, A. von Haeseler, *Bioinformatics* 18, 502-4 (March, 2002); N. Saitou, M. Nei, *Mol Biol Evol* 4, 406-25 (July, 1987)] algorithms were used to confirm similar clustering of sequences in monophylic groups.

Clades were then defined from a Neighbor-Joining phylogenetic tree of all protein sequences. The amino-acid distances were estimated by making use of Poisson-correction. Bootstrap analysis was performed with a 1000 replicates. Sequences were considered monophylic when they had a connecting node within a 0.05 genetic distance. A group of sequences originating from 3 or more sources was considered a clade. The phylogeny of AAV was further evaluated for evidence of recombination through a sequential analysis. Homoplasy was screened for by implementation of the Split Decomposition algorithm [H. J. Bandelt, A. W. Dress, *Mol Phylogenet Evol* 1, 242-52 (September 1992)]. Splits that were picked up in this manner were then further analyzed for recombination making use of the Bootscan algorithm in the Simplot software [M. Nei and S. Kumar, *Molecular Evolution and Phylogenetics* (Oxford University Press, New York, 2000)]. A sliding window of 400 nt (10 nt/step) was used to obtain 100 bootstrap replicate neighbor-joining trees. Subsequently, Split Decomposition and Neighbor-Joining phylogenies were inferred from the putative recombination fragments. Significant improvement of bootstrap values, reduction of splits and regrouping of the hybrid sequences with their parental sources were considered the criterion for recombination.

A number of different cap sequences amplified from 8 different human subjects showed phylogenetic relationships to AAV2 (5') and AAV3 (3') around a common breakpoint at position 1400 of the Cap DNA sequence, consistent with recombination and the formation of a hybrid virus. This is the general region of the cap gene where recombination was detected from isolates from a mesenteric lymph node of a rhesus macaque [Gao et al., *Proc Natl Acad Sci USA* 100, 6081-6086 (May 13, 2002)]. An overall codon based Z- test for selection was performed implementing the Neib-Gojobori method [R. M. Kotin, *Hum Gene Ther* 5, 793-801 (July 1994)].

The phylogenetic analyses were repeated excluding the clones that were positively identified as hybrids. In this analysis, goose and avian AAVs were included as outgroups [(I. Bossis, J. A. Chiorini, *J. Virol* 77, 6799-810 (June 2003)]. FIG. 1 is a neighbor-joining tree; similar relationships were obtained using maximum parsimony and maximum likelihood analyses.

This analysis demonstrated 11 phylogenetic groups, which are summarized in Table 1. The species origin of the 6 AAV clades and 5 individual AAV clones (or sets of clones) is represented by the number or sources from which the sequences were retrieved in the sampling. The total number of sequences gathered per species and per grouping is shown in between brackets. References for previously described sequences per clade are in the right column. Rhesus—rhesus macaques; cyno—cynomologus macaques; chimp—chimpanzees; pigtail—pigtail macaques.

TABLE 1

Classification of the number of sources (sequences) per species and per clade or clone

| | Human | Rhesus | Cyno | Baboon | Chimp | Pigtail |
|---|---|---|---|---|---|---|
| Clade/representative | | | | | | |
| A/AAV1(AAV6) | 3(4) | | | | | |
| B/AAV2 | 12(22) | | | | | |
| C/AAV2–AAV3 hybrid | 8(17) | | | | | |
| D/AAV7 | | 5(10) | 5(5) | | | |
| E/AAV8 | 7(9) | 7(16) | | 1(2) | | 1(3) |
| F/AAV9 | 3(3) | | | | | |

TABLE 1-continued

Classification of the number of sources (sequences) per species and per clade or clone

| | Human | Rhesus | Cyno | Baboon | Chimp | Pigtail |
|---|---|---|---|---|---|---|
| Clones | | | | | | |
| AAV3 | | | | | | |
| AAV4 | | 1(3) | | | | |
| AAV5 | | | | | | |
| Ch.5 | | | | | 1(1) | |
| Rh.8 | | 2(2) | | | | |

Since, as noted above, recombination is not implemented in the standard phylogenetic algorithms used, in order to build a proper phylogenetic tree, those sequences were excluded from the analysis, of which their recombinative ancestry was established. A neighbor-joining analysis of all non-recombined sequences is represented side by side with the clades that did evolve making use of recombination. A similar output was generated with the different algorithm used and with the nucleotide sequence as input.

Additional experiments were performed to evaluate the relationship of phylogenetic relatedness to function as measured by serologic activity and tropism, as described in the following examples.

EXAMPLE 2

Serological Analysis of Novel Human AAVs

1e;.5qThe last lade obtained as described in the preceding example was derived from isolates of 3 humans and did not contain a previously described serotype. Polyclonal antisera were generated against a representative member of this lade and a comprehensive study of serologic cross reactivity between the previously described serotypes was performed. This showed that the new human lade is serologically distinct from the other known serotypes and therefore is called Clade F (represented by AAV9).

Rabbit polyclonal antibodies against AAV serotypes 1-9 were generated by intramuscularly inoculating the animals with $1\times10^{13}$ genome copies each of AAV vectors together with an equal volume of incomplete Freud's adjuvant. The injections were repeated at day 34 to boost antibody titers. Serological cross reactivity between AAV 1-9 was determined by assessing the inhibitory effect of rabbit antisera on transduction of 293 cells by vectors carrying a reporter gene (AAVCMVEGFP, which carries enhanced green fluorescent protein) pseudotyped with capsids derived from different AAV sources. Transduction of 84-31 cells by AAVCMVEGFP vectors was assessed under a UV microscope. In assessing serologic relationships between two AAVs, the ability of both heterologous and homologous sera to neutralize vectors from each AAV were tested. If neutralization by the serum was at least 16-fold lower against heterologous vectors than homologous vectors in a reciprocal manner, the two AAVs are considered distinct serotypes. Neutralization titers were defined as described previously [(G. P. Gao et al., *Proc Natl Acad Sci USA* 99, 11854-9 (Sep. 3, 2002)].

TABLE 2

Serologic evaluation of novel AAV vectors
Vector pseudotypes used in the neutralization assay

| from rabbit immunized with: | AAV2/1 | AAV2/2 | AAV2/3 | AAV2/4 | AAV2/5 | AAV2/6 | AAV2/7 | AAV2/8 | AAV2/9 |
|---|---|---|---|---|---|---|---|---|---|
| AAV2/1 | 1/163,840 | No NAB | No NAB | No NAB | 1/40,960 | 1/40,960 | 1/40 | No NAB | No NAB |

TABLE 2-continued

Serologic evaluation of novel AAV vectors
Vector pseudotypes used in the neutralization assay

| from rabbit immunized with: | AAV2/1 | AAV2/2 | AAV2/3 | AAV2/4 | AAV2/5 | AAV2/6 | AAV2/7 | AAV2/8 | AAV2/9 |
|---|---|---|---|---|---|---|---|---|---|
| AAV2/2 | 1/80 | 1/81,920 | 1/5,120 | 1/20 | No NAB | 1/80 | 1/40 | 1/40 | No NAB |
| AAV2/3 | 1/1,280 | 1/2,560 | 1/40,960 | 1/20 | 1/40 | 1/2,560 | 1/1,280 | 1/1,280 | No NAB |
| AAV2/4 | 1/20 | No NAB | No NAB | 1/1,280 | 1/40 | No NAB | No NAB | No NAB | 1/40 |
| AAV2/5 | 1/20,480 | No NAB | 1/80 | No NAB | 163,840 | 1/5,120 | 1/40 | No NAB | No NAB |
| AAV2/6 | 1/81,920 | No NAB | 1/640 | 1/40 | 1/40 | 1/327,680 | 1/40 | No NAB | 1/40 |
| AAV2/7 | 1/1,280 | 1/640 | 1/1,280 | 1/20 | No NAB | 1/1,280 | 1/163,840 | 1/5,120 | 1/80 |
| AAV2/8 | 1/20 | 1/1,280 | 1/1,280 | No NAB | 1/20 | No NAB | 1/640 | 1/327,680 | 1/2,560 |
| AAV2/9 | No NAB | No NAB | No NAB | No NAB | No NAB | No NAB | 1/20 | 1/640 | 1/20,480 |

These data confirm the phylogenetic groupings of the different clones and clades except for unanticipated serological reactivity of the structurally distinct AAV5 and AAV1 serotypes (i.e., ratio of heterologous/homologous titer were 1/4 and 1/8 in reciprocal titrations).

The result further indicated that AAVhu.14 had a distinct serological property and did not have significant cross reactivity with antisera generated from any known AAV serotypes. The serological distinctiveness of AAVhu.14 was further supported by its uniqueness in the capsid structure which shared less than 85% amino acid sequence identity with all other AAV serotypes compared in this study. Those findings provided the basis for us to name AAVhu.14 as a new serotype, AAV9.

EXAMPLE 3

Evaluation of Primate AAVs as Gene Transfer Vectors

The biological tropisms of AAVs were studied by generating vector pseudotyped in which recombinant AAV2 genomes expressing either GFP or the secreted reporter gene α-1 antitrypsin (A1AT) were packaged with capsids derived from various clones and one representative member from each primate AAV clade for comparison. For instance, the data obtained from AAV1 was used to represent Clade A, followed by AAV2 for Clade B, Rh.34 for AAV4, AAV7 for Clade D, AAV8 for Clade E, and AAVHu.14 for Clade F. AAV5, AAVCh.5 and AAVRh.8 stand as single AAV genotypes for the comparison.

The vectors were evaluated for transduction efficiency in vitro, based on GFP transduction, and transduction efficiency in vivo in liver, muscle or lung (FIG. 4).

A. In Vitro

Vectors expressing enhanced green fluorescent protein (EGFP) were used to examine their in vitro transduction efficiency in 84-31 cells and to study their serological properties. For functional analysis, in vitro transduction of different AAVCMVEGFP vectors was measured in 84-31 cells that were seeded in a 96 well plate and infected with pseudotyped AAVCMVEGFP vectors at an MOI of $1 \times 10^4$ GC per cell. AAV vectors were pseudotyped with capsids of AAVs 1, 2, 5, 7, 8 and 6 other novel AAVs (Ch.5, Rh.34, Cy5, rh.20, Rh.8 and AAV9) using the technique described in G. Gao et al., Proc Natl Acad Sci USA 99, 11854-9 (Sep. 3, 2002). Relative EGFP transduction efficiency was scored as 0, 1, 2 and 3 corresponding to 0-10%, 10-30%, 30-70% and 70-100% of green cells estimated using a UV microscope at 48 hours post infection.

B. In Vivo

For in vivo studies, human α-antitrypsin (A1AT) was selected as a sensitive and quantitative reporter gene in the vectors and expressed under the control of CMV-enhanced chicken β-actin promoter. Employment of the CB promoter enables high levels of tissue non-specific and constitutive A1AT gene transfer to be achieved and also permits use of the same vector preparation for gene transfer studies in any tissue of interest. Four to six week old NCR nude mice were treated with novel AAV vectors (AAVCBhA1AT) at a dose of $1 \times 10^{11}$ genome copies per animal through intraportal, intratracheal and intramuscular injections for liver, lung and muscle directed gene transfer, respectively. Serum samples were collected at different time points post gene transfer and A1AT concentrations were determined by an ELISA-based assay and scored as 0, 1, 2 and 3 relative to different serum A1AT levels at day 28 post gene transfer, depending on the route of vector administration (Liver: 0=A1AT<400 ng/ml, 1=A1AT 400-1000 ng/ml, 2=A1AT 1000-10,000 ng/ml, 3=A1AT>10,000 ng/ml; Lung: 0=A1AT<200 ng/ml, 1=A1AT 200-1000 ng/ml, 2=A1AT 1000-10,000 ng/ml, 3=A1AT>10,000 ng/ml; Muscle: 0=A1AT<100 ng/ml, 1=A1AT 100-1000 ng/ml, 2=A1AT 1000-10,000 ng/ml, 3=A1AT>10,000 ng/ml).

A human AAV, clone 28.4/hu.14 (now named AAV9), has the ability to transduce liver at a efficiency similar to AAV8, lung 2 logs better than AAV5 and muscle superior to AAV1, whereas the performance of two other human clones, 24.5 and 16.12 (hu.12 and hu.13) was marginal in all 3 target tissues. Clone N721.8 (AAVrh.43) is also a high performer in all three tissues.

To further analyze gene transfer efficiency of AAV9 and rh 43 in comparison with that of bench markers for liver (AAV8), lung (AAV5) and muscle (AAV1), a dose response experiment was carried out. Both new vectors demonstrated at least 10 fold more gene transfer than AAV1 in muscle, similar performance to AAV8 in liver and 2 logs more efficient than AAV5 in lung.

A group of AAVs demonstrated efficient gene transfer in all 3 tissues that was similar or superior to the performance of their bench marker in each tissue has emerged. To date, 3 novel AAVs have fallen into this category, two from rhesus (rh10 and 43) and one from human (hu.14 or AAV9). A direct comparison of relative gene transfer efficiency of those 3 AAVs to their bench markers in the murine liver, lung and muscle suggests that some primate AAVs with the best fitness might have evolved from rigorous biological selection and evolution as "super" viruses. These are particularly well suited for gene transfer applications.

C. Profiles of Biological Activity

Unique profiles of biological activity, in terms of efficiency of gene transfer, were demonstrated for the different AAVs with substantial concordance within members of a set of clones or clade. However, in vitro transduction did not predict the efficiency of gene transfer in vivo. An algorithm for comparing the biological activity between two different AAV pseudotypes was developed based on relative scoring of the level of transgene expression and a cumulative analysis of differences.

Cumulative differences of the gene transfer scores in vitro and in vivo between pairs of AAVs were calculated and presented in the table (ND=not determined) according to the following formula. Cumulative functional difference in terms of scores between vectors A and B=in vitro (A−B)+lung (A−B)+liver (A−B)+muscle (A−B). The smaller the number, the more similar in function the AAVs. In the grey shaded area, the percentage difference in sequence is represented in bold italic. The percentage difference in cap structure was determined by dividing the number of amino-acid differences after a pairwise deletion of gaps by 750, the length of the VP1 protein sequence alignment.

and the rh.8 clone, which were isolated exclusively from macaques, and the Clade F, which is human specific. The remaining clade within this group (i.e., Clade E) has members from both humans and a number of nonhuman primate species suggesting transmission of this clade across species barriers. It is interesting that the capsid structures of Clade E members isolated from some humans are essentially identical to some from nonhuman primates, indicating that very little host adaptation has occurred. Analysis of the biology of AAV8 derived vectors demonstrated a broad range of tissue tropism with high levels of gene transfer, which is consistent with a more promiscuous range of infectivity, and may explain its apparent zoonosis. An even greater range and efficiency of gene transfer was noted for the Clade F, highlighting the potential for cross species transmission, which to date has not been detected.

The presence of latent AAVs widely disseminated throughout human and nonhuman primates and their apparent predisposition to recombine and to cross species barriers raises important issues. This combination of events has the potential to lead to the emergence of new infectious agents with modified virulence. Assessing this potential is confounded by the

|      | AAV1 | AAV2 | AAV3 | Ch.5 | AAV4 | AAV5 | AAV7 | AAV8 | Rh.8 | AAV9 |
|------|------|------|------|------|------|------|------|------|------|------|
| AAV1 | 0    | 5    | ND   | 4    | 4    | 4    | 2    | 4    | 5    | 4    |
| AAV2 | *16.3* | 0  | ND   | 3    | 2    | 4    | 7    | 7    | 6    | 9    |
| AAV3 | *13.2* | *12.3* | 0 | ND | ND   | ND   | ND   | ND   | ND   | ND   |
| Ch.5 | *15.5* | *10.5* | *11.5* | 0 | 2 | 4    | 6    | 6    | 5    | 8    |
| AAV4 | *33.7* | *36.7* | *34.8* | *34.9* | 0 | 2 | 7    | 6    | 5    | 8    |
| AAV5 | *39.1* | *38.8* | *38.5* | *38.4* | *42.7* | 0 | 4 | 4    | 3    | 6    |
| AAV7 | *14.1* | *16.7* | *14.9* | *15.6* | *33.2* | *38.5* | 0 | 2 | 3    | 2    |
| AAV8 | *15.6* | *16.4* | *14*  | *15.6* | *33.2* | *38.9* | *11.6* | 0 | 1 | 2    |
| Rh.8 | *14.1* | *15.2* | *14.3* | *14.4* | *33.7* | *39.6* | *12.1* | *8.8* | 0 | 3    |
| AAV9 | *17.2* | *17.3* | *15.6* | *14.8* | *34.5* | *39.7* | *17.5* | *14.3* | *12.5* | 0 |

These studies point out a number of issues relevant to the study of parvoviruses in humans. The prevalence of endogenous AAV sequences in a wide array of human tissues suggests that natural infections with this group of viruses are quite common. The wide tissue distribution of viral sequences and the frequent detection in liver, spleen and gut indicate that transmission occurs via the gastrointestinal track and that viremia may be a feature of the infection.

The tremendous diversity of sequence present in both human and nonhuman primates has functional correlates in terms of tropism and serology, suggesting it is driven by real biological pressures such as immune escape. Clearly, recombination contributes to this diversity as evidenced by the second most common human clade, which is a hybrid of two previously described AAVs.

Inspection of the topology of the phylogenetic analysis reveals insight into the relationship between the evolution of the virus and its host restriction. The entire genus of dependoviruses appears to be derived from avian AAV consistent with Lukashov and Goudsmit [(V. V. Lukashov, J. Goudsmit, J Virol 75, 2729-40 (March, 2001)]. The AAV4 and AAV5 isolates diverged early from the subsequent development of the other AAVs. The next important node divides the species into two major monophilic groups. The first group contains clones isolated solely from humans and includes Clade B, AAV3 clone, Clade C and Clade A; the only exception to the species restriction of this group is the single clone from chimpanzees, called ch.5. The other monophilic group, representing the remaining members of the genus, is derived from both human and nonhuman primates. This group includes Clade D fact that the clinical sequalae of AAV infections in primates has yet to be defined. In addition, the high prevalence of AAV sequences in liver may contribute to dissemination of the virus in the human population in the setting of allogeneic and xenogenic liver transplantation. Finally, the finding of endogenous AAVs in humans has implications in the use of AAV for human gene therapy. The fact that wild type AAV is so prevalent in primates without ever being associated with a malignancy suggests it is not particularly oncogenic. In fact, expression of AAV rep genes has been shown to suppress transformation P. L. Hermonat, *Virology* 172, 253-61 (September, 1989)].

EXAMPLE 4

AAV2/9 Vector for the Treatment of Cystic Fibrosis Airway Disease

To date, CFTR gene transfer to the lung for the treatment of CF airway disease has been limited by poor vector performance combined with the significant barriers that the airway epithelium poses to effective gene transfer. The AAV2 genome packaged in the AAV9 capsid (AAV2/9) was compared to AAV2/5 in various airway model systems.

A 50 μl single dose of $1 \times 10^{11}$ genome copies (gc) of AAV2/9 expressing either the nuclear targeted β-galactosidase (nLacZ) gene or the green fluorescence protein (GFP) gene under the transcriptional control of the chicken β-actin promoter was instilled intranasally into nude and also C57Bl/6 mice. Twenty-one days later, the lung and nose were processed for gene expression. In control animals transduced with AAV2/9-GFP, no LacZ positive cells were seen. AAV2/9-nLacZ successfully transduced mainly airways, whereas AAV2/5-nLacZ transduced mainly alveoli and few airways. Across the nasal airway epithelium, both AAV2/5 and AAV2/9 transduced ciliated and non-ciliated epithelial cells.

Epithelial cell specific promoters are currently being evaluated to improve targeting to the airway cells in vivo. Based on the in vivo findings, the gene transfer efficiency of AAV2/9 to human airway epithelial cells was tested next. Airway epithelial cells were isolated from human trachea and bronchi and grown at air-liquid-interface (ALI) on collagen coated membrane supports. Once the cells polarized and differentiated, they were transduced with AAV2/9 or AAV2/5 expressing GFP from the apical as well as the basolateral side. Both AAV2/5 and AAV2/9 were successful at transducing epithelial cells from the basolateral surface. However, when applied onto the apical surface AAV2/9 resulted in a 10-fold increase in the number of transduced cells compared to AAV2/5. Currently, the gene transfer performance of AAV2/9 in the lungs and nasal airways of nonhuman primates is being evaluated.

This experiment demonstrates that AAV2/9 can efficiently transduce the airways of murine lung and well-differentiated human airway epithelial cells grown at ALI.

EXAMPLE 5

Comparison of Direct Injection of AAV1(2/1) and AAV9(2/9) in Adult Rat Hearts

Two adult (3 month old) rats received a single injection of $5 \times 10^{11}$ particles of AAV2/1 or AAV2/9 in the left ventricle The results were spectacular, with significantly more expression observed in the adult rat heart with AAV2/9 vectors as compared to AAV2/1, as assessed by lacZ histochemistry. AAV2/9 also shows superior gene transfer in neonatal mouse heart.

EXAMPLE 6

AAV2/9 Vector for Hemophilia B Gene Therapy

In this study, AAV2/9 vectors are shown to be more efficient and less immunogenic vectors for both liver and muscle-directed gene therapy for hemophilia B than the traditional AAV sources.

For a liver-directed approach, evaluation of the AAV2/9 pseudotyped vector was performed in mouse and dog hemophilic models. In immunocompetent hemophilia B mice (in C57BL/6 background), long-term superphysiological levels of canine Factor IX (cFIX, 41-70 μg/ml) and shortened activated partial thromboplastin time (aPTT) have been achieved following intraportal injection of $1 \times 10^{11}$ genome copies (GC)/mouse of AAV2/7, 2/8, and 2/9 vectors in which the cFIX is expressed under a liver specific promoter (LSP) and woodchuck hepatitis B post-transcriptional responsive element (WPRE). A 10-fold lower dose ($1 \times 10^{11}$ GC/mouse) of AAV2/8 vector generated normal level of cFIX and aPTT time. In University of North Caroline (UNC) hemophilia B dogs, it was previously demonstrated that administration of an AAV2/8 vector into a dog previously treated with an AAV2 vector was successful; cFIX expression peaked at 10 μg/ml day 6 after the $2^{nd}$ intraportal injection (dose=$5 \times 10^{12}$ GC/kg), then gradually decreased and stabilized around 700 ng/ml (16% of the normal level) throughout the study (1 1/2 years). This level was about 3-fold higher than that from a hemophilia B dog that received a single injection of AAV2-cFIX at the similar dose. Recently, two naïve hemophiilia B dogs were injected with AAV2/8 vectors intraportally at the dose of $5.25 \times 10^{12}$ GC/kg. cFIX levels in one dog (male) reached 30% of normal level (1.5 μg/ml) ten weeks after injection and has sustained at 1.3-1.5 μg/ml, while the second dog (female) maintained cFIX expression at about 10% of normal level. Whole blood clotting time (WBCT) and aPTT were both shortened after the injection, suggesting the antigen was biologically active. Liver enzymes (aspartate amino transferase (SGOT), alanine amino transferase (SGPT) in both dogs remained in the normal range after surgery. These AAV were also evaluated for muscle-targeted gene therapy of hemophilia B. AAV-CMV-cFIX-WPRE [an AAV carrying cFIX under the control of a CMV promoter and containing the WPRE] packaged with six different AAV sources were compared in immunocompetent hemophilia B mice (in C57BL/6 background) after intramuscular injection at the dose of $1 \times 10^{11}$ GC/mouse. cFIX gene expression and antibody formation were monitored. Highest expression was detected in the plasma of the mice injected with AAV2/8 vectors (1460±392 ng/ml at day 42), followed by AAV2/9 (773±171 ng/ml at day 42) and AAV2/7 (500±311 ng/ml at day 42). Levels were maintained for 5 months. Surprisingly, cFIX expression by AAV2/1 ranged from 0-253 ng/ml (average: 66±82 ng/ml). Anti-cFIX inhibitor (IgG) was detected in some of the AAV2/1-injected mice. cFIX expression levels in these mice correlated well with inhibitor levels. Further screening of inhibitor formation was performed on day 28 samples for all AAV. Hemophilia B mice showed highest inhibitor formation against AAV2/2, followed by AAV2/5, and AAV2/1. Only sporadic and low level inhibitors were detected in animals injected with AAV2/7, AAV2/8 and AAV2/9. Thus, the advantages of the new AAV serotype 2/9 vectors for muscle-directed gene therapy for hemophilia B as more efficient and safe vectors without eliciting any significant anti-FIX antibody formation are shown.

EXAMPLE 7

Novel Rh.43 Vectors of Invention

A. Comparison of AAVrh.43 Based A1AT Expression Vector with AAV8 and AAV9 in Mouse Liver Directed Gene Transfer Novel AAVrh.43, which belongs to Clade E by phylogenetic analysis vector was compared to AAV8 and novel AAV9 for hA1AT levels after intraportal infusion to the mouse liver. More particularly, pseudotyped AAVrh.43, AAV2/8 and AAV2/9 vectors were compared in mouse liver-directed gene transfer. Pseudotyped vectors at doses of $1 \times 10^{11}$ GC, $3 \times 10^{10}$ GC and $1 \times 10^{10}$ GC per animal were administrated to 4-6 week old C57BL/6 mouse intramuscularly. Serum samples were collected from animals at day 28 post vector infusion for the human alpha 1 anti-trypsin (hA1AT) assay.

The data indicated that the novel AAVrh.43 vector had indeed a performance similar to that of AAV9 in the mouse model.

B. Nuclear Target LacZ Gene Transfer to Mouse Liver and Muscle Mediated by Pseudotyped AAV Vectors.

Novel AAV9 and AAVrh.43 based vectors of the invention were compared to AAV1 and AAV2-based vector. The vectors were injected at a dose of $1 \times 10^{11}$ GC per mouse either intraportally to target liver or intramuscularly to the right anterior tibialis muscle of C57BL/6 mice intramuscularly. The animals were sacrificed at day 28 post gene transfer and tissues of interest harvested for X-gal histochemical staining.

The AAVrh.43 vector demonstrated gene transfer efficiency that was close to AAV9 but at least 5 fold higher than AAV1. The property of AAVrh.43 was further analyzed in both liver and muscle using nuclear targeted LacZ gene as a reporter to visualize extend of gene transfer histochemically.

C. Comparison of AAVrh.43 Based A1AT Expression Vector with AAV5 in Mouse Lung Directed Gene Transfer A novel rh.43-based vector of the invention also demonstrated superb gene transfer potency in lung tissue. Different doses ($1 \times 10^{10}$, $3 \times 10^{10}$ and $1 \times 10^{11}$ GC per animal) of pseudotyped vectors were administered to 4-6 week old C57BL/6 mouse lungs intratracheally. Serum samples were collected from animals at different time points for hA1AT assay.

This vector was compared to AAV5 at different doses for levels of hA1AT detected systematically after intratracheal instillation to the mouse lung. The data indicated that this novel vector was at lease 100 fold more efficient than AAV5 in the mouse model.

EXAMPLE 8

Novel Human AAV Based Vectors in Mouse Models for Liver and Lung-directed Gene Transfer The human clones, AAVhu.37, AAVhu.41 and AAVhu.47 were pseudotyped and examined for gene transfer potency in mouse tissues. AAVCBA1AT vectors pseudotyped with capsids of hu.37, hu.41 and hu.47 were prepared using the methods described herein and administered to 4-6 week old C57BL/6 mouse through intraportal and intratracheal injections. Serum samples were collected from animals at day 14 post vector injection for hA1AT assay, which was performed in accordance with published techniques. AAVhu.47 belongs to AAV2 family (clade B) AAV2 and was isolated from a human bone marrow sample. AAVhu.37 and AAVhu.41 came from a human testis tissue and a human bone marrow sample respectively. Phylogenetically, they fall into the AAV8 clade (clade E).

Serum A1AT analysis of injected animals indicated that AAV hu.41 and AAV hu.47 performed poorly in the three tissues tested. However, gene transfer potency of AAVhu.37 derived vector was similar to that of AAV8 in liver and AAV9 in lung All publications cited in this specification are incorporated herein by reference. While the invention has been described with reference to particularly preferred embodiments, it will be appreciated that modifications can be made without departing from the spirit of the invention.

SEQUENCE LISTING (236 sequences)

SEQ ID NO: 1 - DNA, 2211 bp, Unknown
  adeno-associated virus, clone hu.31
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 2 - DNA, 2211 bp, Unknown
  new AAV serotype, clone hu.32
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggttcacagcccgctaaaaagaaactcaatttcggtcagactggcgacacagagtcagtccccgaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatgggagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagcgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctaatgggagggtttggaatgaagcacccgcctcctcagatcctcatcaaaaacacacctgtacctgcggatcctccaacggctttcaataaggacaagctgaactctttcatcacccagtattctactggccaagtcagcgtggagattgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 3 - DNA, 2211 bp, Unknown; identical to SEQ ID NO: 1
  adeno-associated virus, human clone 9

SEQ ID NO: 4 - DNA, 2217 bp, Unknown
  new AAV serotype, clone hu.17
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctgcaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactataacaaatctgttaatgtggactttactgtggacactaatggtgtgtattcagagcctcgccccattggcaccagatacctgactcgtaatctgtaa

SEQ ID NO: 5 - DNA, 2217 bp, Unknown
  new AAV serotype, clone hu.6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagacaggccagcagcccgcgaaaaagagactcaactttgggcagactggcgactcagagtcagtgcccgaccctcaaccaatcggagaaccccccgcaggcccctctggtctgggatctggtacaatggctgcaggcggtggcgctccaatggcagacaataacgaaggcgccgacggagtgggtagttcctcaggaaattggcattgcgattccgcatggctgggcgacagagtcatcaccaccagcacccgaccctgggccctccccacctacaacaaccacctctacaagcaaatctccaacgggacatcgggaggaagcaccaacgacaacacctacttcggctacagcaccccctgggggtattttgactttaacagattccactgccacttctcaccacgtgactggcagcgactcatcaacaacaactggggattccggcccaagagactcaacttcaagctcttcaacatccaggtcaaggaggtcacgcagaatgaaggcaccaagaccatcgccaataaccttaccagcacgattcaggtctttacggactcggaataccagctcccgtacgtcctcggctctgcgcaccagggctgcccgcctccgttcccggcggacgtcttcatgattcctcagtacgggtacctgactctgaacaacggcagtcaggccgtgggccgttcctccttctactgcctggagtactttccttctcaaatgcggagaacgggcaacaactttgagttcagctaccagtttgaggacgtgccttttcacagcagctacgcgcatagccaaagcctggaccggctgatgaaccccctcatcgaccagtacctgtactacctgtctcggactcagtccacgggaggtaccgcaggaactcagcagttgctattttctcaggccgggcctaataacatgtcggctcaggccaaaaactggctacccgggccctgctaccggcagcaacgcgtctccacgacactgtcgcaaaataacaacagcaactttgcttggaccggtgccaccaagtatcatctgaatggcagagactctctggtaaatcccggtgtcgctatggcaacgcacaaggacgacgaagagcgattttttccatccagcggagtcttgatgtttgggaaacagggagctggaaaagacaacgtggactatagcagcgttatgctaaccagtgaggaagaaatcaaaaccaccaacccagtggccacagaacagtacggcgtggtggccgataacctgcaacagcaaaacgccgctcctattgtaggggccgtcaacagtcaaggagccttacctggcatggtctggcagaaccgggacgtgtacctgcagggtcctatctgggccaagattcctcacacggacggcaactttcatccttcgccgctgatgggaggctttggactgaaacacccgcctcctcagatcctgattaagaatacacctgttcccgcggatcctccaactaccttcagtcaagccaagctggcgtcgttcatcacgcagtacagcaccggacaggtcagcgtggaaattgaatgggagctgcagaaagagaacagcaagcgctggaacccagagattcagtatacttccaactactacaaatctacaaatgtggactttgctgtcaatactgagggtacttattcagagcctcgccccattggcacccgttacctcacccgtaacctgtaa

SEQ ID NO: 6 - DNA, 2217 bp, Unknown
  new AAV serotype, clone hu.41
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtccggttgaggaagctgctaagacggctcctggaaagaagagaccggtagaaccgccacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccgtcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgttggaacccagagattcagtacacttcaaactactacaaatctacaaatgtggactttgctgtcaatacagagggaacttattctgagcctcgccccattggtactcgttacctcacccgtaatctgtaa

SEQ ID NO: 7 - DNA, 2217 bp, Unknown
  new AAV serotype, clone rh.38
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctacaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcggcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagcccttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgcactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgctacctcacccgtaatctgtaa

SEQ ID NO: 8 - DNA, 2217 bp, Unknown
  new AAV serotype, clone hu.42
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagcggctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaagcaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggacttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 9 - DNA, 2217 bp, Unknown
  new AAV serotype, clone rh.72
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 10 - DNA, 2217 bp, Unknown
  new AAV serotype, clone hu.37
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgttcggaaaacagggtgctggaagagacaatgtggactacagcagcgttatgctaaccagcgaagaagaaattaaaaccactaaccccgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 11 - DNA, 2217 bp, Unknown
  new AAV serotype, clone hu.40
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgagctttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattctgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 12 - DNA, 2217 bp, Unknown
  new AAV serotype, clone hu.38
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccacctgcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggagggagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaactgccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 13 - DNA, 2217 bp, Unknown
  new AAV serotype, clone rh.39
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgataacttgcagcaaaccaatacggggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 14 - DNA, 2217 bp, Unknown
  new AAV serotype, clone rh.40
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcaggatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcgggctaagaactggctacctggaccttgctaccggcagcagcgagtctctacgacactgtcgcaaaacaacaacagcaactttgcttggactggtgccaccaaatatcacctgaacggaagagactctttggtaaatcccggtgttgctatggcaacgcataaggacgacgaggaacgtttctttccatcgagcggagtcctgatgtttggaaaacagggtgctggaagagacaatgtggactatagcagcgttatgctaaccagcgaggaagaaattaaaaccactaaccctgtagccacagaacaatacggtgtggtggctgacaacttgcagcaagccaatacagggcctattgtgggaaatgtcaacagccaaggagccttacctggcatggtctggcagaaccgagacgtgtacctgcagggtcccatctgggccaaaattcctcacacggacggcaattttcacccgtctcctctgatgggcggctttggactgaagcacccacctccccagatcctgatcaagaatacgccggtacctgcggatcctccaacgacgttcagccaggcaaaattggcttccttcatcacgcagtacagcaccggccaggtcagcgtggagatcgagtgggagctgcagaaggagaacagcaagcgatggaacccagaaattcagtacacttccaactactacaaatctacaaatgtggactttgctgtcaattctgagggtacatattcagagcctcgccccattggtactcgttatctgacacgtaatctgtaa

SEQ ID NO: 15 - DNA, 2217 bp, Unknown
  new AAV serotype, clone rh.64
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgtgtgggagctgcagaaggagaacagcaagcgcaggaacccagagattcagtatacttccaactactacaaatctacaaatgtggactttgctgttaatactgagggtgtttactctgagcctcgccccattggcactcgttacctcacccgtaatctgtaa

SEQ ID NO: 16 - DNA, 2217 bp, Unknown
  new AAV serotype, clone rh.68
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccacccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggtgatcgagtgggagctgcagaaggagaacagcaagcgctggaacccagagattcagtatacttccaactactacaaatctacaaatgtggactttgctgttaatactgagggtgtttactctgagcttcgccccattggcactcgttacctcacccgtaatctgtaa

SEQ ID NO: 17 - DNA, 2217 bp, Unknown
  new AAV serotype, clone rh.53
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgtgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaattcgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttaccccacccgtaatctgtaa

SEQ ID NO: 18 - DNA, 2217 bp, Unknown
  new AAV serotype, clone rh.52
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaatagcctcaccagcaccatccaggtgtttacggactcggaataccagctgccgtacgtcctcggctctgcccaccagggctgcctgcctccgttcccggcggacgtcttcatgattcctcagtacggctacctgactcccaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgtcttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacttgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 19 - DNA, 2217 bp, Unknown
  new AAV serotype, clone rh.46
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaaggccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 20 - DNA, 2217 bp, Unknown
  new AAV serotype, clone rh.70
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccgcctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggatgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgagcggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattcttccatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatttgtaa

SEQ ID NO: 21 - DNA, 2217 bp, Unknown
  new AAV serotype, clone rh.61
atggctgccgatggttatcttccagattggctcgaggacaacctctctgagggcattcgcgagtggtgggacctgaaacctggagccccgaaacccaaggccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgacccatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctaccctttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaagacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcaggtcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 22 - DNA, 2217 bp, Unknown
  new AAV serotype, clone rh.51
atggttgccgatggttatcttccagattggctcgaggacaacctctctgagggcattcgcgagtggtgggacctgaaacctggagccccgaaacccaaagccaaccagcaaaagcagggcgacggccggggtctggtgcttcctggctacaagtacctcggacccttcaacggactcgacaagggggagcccgtcaacgcggcggacgcagcggccctcgagcacgacaaggcctacgaccagcagcttaaagcgggtgacaatccgtacctgcggtataatcacgccgacgccgagcttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgccagcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagccgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 23 - DNA, 2217 bp, Unknown
  new AAV serotype, clone rh.50
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccggaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcgtcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggagcccagagattcagtatacttccaactactacaaatctacaaatgtggactttgctgttaatactgagggtgtttactctgagcctcgccccattggcactcgttacctcacccgtaatctgtaa

SEQ ID NO: 24 - DNA, 2217 bp, Unknown
  new AAV serotype, clone hu.39
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcggactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagttatcaccaccagcacccgaacctgggccctgcccacctacaacaaccacctctacaagcaaatctccaacgggacctcgggaggcagcaccaacgacaacacctactttggctacagcaccccctgggggtatcttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcgccagcaccatccaggtgtttacggactcggaataccagccgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcgggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctactgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcgcgcagtacagcaccggacaagtcagcgtggagatcgagtgggagctgcagaaggagaacagcaagcgctggaacccagagattcagtatacttccaactactacaaatctacaaatgcggactttgctgttaatactgagggtgtttactctgagcctcgccccattggcactcgttacctcacccgtaatctgtaa

SEQ ID NO: 25 - DNA, 2217 bp, Unknown
  new AAV serotype, clone rh.49
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgcacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacttatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggagtaccagctgccgtacgtcctcggctctgcccaccagggctgcctgcctccgttcccggcggacgtcttcatgattcctcagtacggcaacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacatgggctatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacggcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 26 - DNA, 2217 bp, Unknown
  new AAV serotype, clone rh.57
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcgccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaacctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgcggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 27 - DNA, 2217 bp, Unknown
  new AAV serotype, clone rh.58
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaacctccagcagcgccctctagtgtgggatctggtacaatggccgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagctgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaagcactcctgttcctgcggatcctccaacagcgttcaaccaggccaagctgaattctttcatcacgcagtacagcaccggacaagtcagcgtggagatcgagtgggagctgcagaaggagaacagcaagtgctggaacccagagattcagtatacttccaactactacaaatctacaaatgtggactttgctgttaatactgagggtgtttactctgagcctcgccccattggcactcgttacctcacccgtaatctgtaa

SEQ ID NO: 28 - DNA, 2196 bp, Unknown
  new AAV serotype, clone pi.1
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggcagactggcgactcagagtcagtgcctgacccccaacctctctcagaaccacccgcaggtccctctggtctgggatctggtacaatggctgctggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactgggggttccggcccaagaagctcaacttcaagctcttcaacatccaggtcaaggaggtcacccagaatgaaggcaccaagaccatcgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgagccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggcgtggtggctgacaatctgcagcagaccaactcagctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 29 - DNA, 2196 bp, Unknown
  new AAV serotype, clone pi.3
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccagcagcccgcgaaaaagagactgaattttgggccgactggcgactcagagtcagtgcctgacccccaacctctctcagaaccacctgcaggtccctctggtctgggatctggtacaatggctgcaggcggtggcgctccaatggcagacaataacgaaggcgccgacggagtgggtaatgtctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgcgactggcagcgactcatcaacaacaactggggattccggcccaagaagctcaacttcaagctcttcaacatccaggtcaaggaggtcacccagaatgaaggcaccaagaccaccgccaataacctcaccagcacggtgcaggtctttacggactcggagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacggcagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagcgaaccccgccccattggcactcgttacctcacccgtaatctgtaa

SEQ ID NO: 30 - DNA, 2196 bp, Unknown
  new AAV serotype, clone pi.2
atggctgctgacggttatcttccagattggctcgaggacaacctctctgagggcattcgcgagtggtgggcgctgaaacctggagccccgcaacccaaagccaaccagcaaaagcaggacgacggccggggtctggtgcttcctggctacaagtacctcggacccttcaacggactcgacaagggggagcccgtcaacgaggcggacgccgcggccctcgagcacgacaaggcctacgaccagcagctcaaagcgggtgacaatccgtacctgcggtataatcacgccgacgccgagtttcaagagcgtctgcaagaagatacgtcctttgggggcaacctcgggcgagcagtcttccaggccaaaaagagggtactcgagcctctgggtctggttgaggaaggcgctaagacggctcctggaaagaagcggccagtagaaccggactccagctcgggcatcggcaagtcaggccggcagcccgcgaaaaagagactgaattttgggcagactggcgactcagagtcagtgcctgacccccaacctctctcagaaccacccgcaggtccctctggtctgggatctggtacaatggctgcaggcggtggcgctccaatggcagacaataacgaaggcgccgacggagtgggtaatgcctcaggaaattggcattgcgattccacatggctgggcgaccgagtcatcaccaccagcactcggacctgggccctccccacctacaacaaccacctctacaagcaaatctccaacgggacctcgggaggcagcagcaacgacaacacctactttggctacagcaccccctgggggtattttgactttaacagattccactgccacttttcaccacgtgactggcagcgactcatcaacaacaactggggattccggcccaagaggctcaacttcaagctcttcaacatccaggtcaaggaggtcacccagaatgaaggcaccaagaccatcgccaataacctcaccagcacggtgcaggtctttacggactcgaagtaccagctcccgtacgtgctcggctctgcccaccagggctgcctgcctccgttcccggcggacgtgttcatgattccgcagtacgggtacctgacgctgaacaacgggagccaggccgtggggcgatcctccttctactgcctggagtactttccctcgcagatgctgagaacgggcaacaactttaccttcagctacaccttcgaggacgtgcccttccacagcagctacgcgcacagccagagcctggaccggctgatgaacccgctgattgaccagtacctgtactacctgtctcggactcagaccaacgggaccaatgccacgcagactctgttgtttgctcaggccgggcctcagaacatgtcggctcaggccaagaactggctgcctggtccttgctatcggcagcagcgcgtctctacgacagtgtcgcaaaacaacaacagcaactttacctggaccggggcgaccaagtaccacctgaacggccgagactccctggtgaaccccggtgtcgccatggcaacgcacaaggacgacgaggagcgcttcttcccgagcagcggggtcctgatgtttggcaagcagggcgctggaaaggacaatgtcgagtacaccaacgtgatgctcaccagcgaggaggagatcaagaccaccaaccctgtggccacggagcagtacggtgtggtggctgacaatctgcagcagaccaactcggctcccattgtgggggcagtcaacagccagggggccttacccggtatggtctggcagaaccgggacgtgtacctgcagggtcccatctgggccaagatcccgcatacggacggcaactttcacccgtctcctctcatgggcggctttggactgaaacacccgcctccccagatcctgatcaaaaacacgccggtacctgcggatcccccggtgaactttacggacgctaagctggcgagtttcatcacgcagtacagcaccgggcaggtcagcgtggagattgagtgggagctgcagaaggagaacagcaagcgctggaatcccgagattcagtacacttccaattattataaatcagctaatgtggactttgccgtcaatgcagatggtgtatatagtgaaccccgccccattggcactcgttacctcacccgtaatctgtaa

SEQ ID NO: 31 - DNA, 2208 bp, Unknown
  new AAV serotype, clone rh.60
atggctgccgatggttatcttccagattggctcgaggacaacctctctgagggcattcacgagtggtgggacccgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacccacaacaaccacctctacaagcaaatctccaacgggacctcgggaggcagcaccaacgacaacgtctacttcggctacagcaccccctgggggtattttgacttcaacagattccactgtcacttctcaccacgtgaccggcagcgactcatcaacaacaactggggattccggcccaagagactcagcttcaagctcttcaacatccaggtcaaagaggtcacgcagaatgaaggcaccaagaccatcgccaataacctcaccagcaccatccaggtgtttacggactcggaataccagctgccgtacgtcctcggctctgcccaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacggaaggcacagcgggaacccagcagttgctgttttctcaggccgggcctagcaacatgtcggctcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 32 - DNA, 2214 bp, Unknown
  new AAV serotype, clone rh.48
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacagcaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 33 - DNA, 2214 bp, Unknown
  new AAV serotype, clone rh.62
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagttccaggagcgtctgcaagaagatacgtcttttgggggcaacctcgggcgagcagtcttccaggccaagaagcgggttctcgaacctctcggtctggctgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagagccaccagcaggcccctctggtctgggatctggtacaatggctgcaggcggtggcgcaccaatggctgacaataacaagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgggtgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatgacagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 34 - DNA, 2214 bp, Unknown
  new AAV serotype, clone rh.44
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcagcgcggcggacgcagcggccctcgagcacgacaaggcctgcgaccagcggctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagggaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaatcacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacgaacagactggtgtggactttgccgttgacagccagggtgtttattctgagcctcgccccattggtactcgttacctcacccgtaatctgtaa

SEQ ID NO: 35 - DNA, 2214 bp, Unknown
  new AAV serotype, clone rh.65
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctagaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 36 - DNA, 2214 bp, Unknown
  new AAV serotype, clone rh.67
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccatgccgacgccgagtttcaggagcgtctgcaagaagatacgtcttttgggggcaacctcgggcgagcagtcctccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 37 - DNA, 2214 bp, Unknown
  new AAV serotype, clone rh.55
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataatcacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacacggctgggcgacagagtcatcaccaccagcacccggacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacgaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 38 - DNA, 2217 bp, Unknown
  new AAV serotype, clone rh.47
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagcacctcggacccttcaacggactcgacaagggggagcccgtcaacgcggcggacgcagcggccctcgagcacgacaaggcctacgaccagcagctcaaagcgggtgacaatccgtacctgcggtataatcacgctgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccgtcaccacagcgttcccccgactcctccacgggcatcggcaagaaaggccagcagcccgccagaaagagactcaatttcggtcagactggcgactcagagtcagtccccgaccctcaacctatcggagaacctccagcagcgccctctagtgtgggatctggtacaatggctgcaggcggtggcgcaccaatggcagacaataacgaaggtgccgacggagtgggtagttcctcgggaaattggcattgcgattccacatggctgggcgacagagtcatcaccaccagcacccgaacctgggccctgcccacctacaacaaccacctctacaagcaaatctccaacgggacctcgggaggcagcaccaacgacaacacctactttggctacagcaccccctgggggtattttgactttaacagattccactgccacttctcaccacgtgactggcagcgactcatcaacaacaactggggattccggcccaagagactcagcttcaagctcttcaacatccaggtcaaagaggtcacgcagaatgaaggcaccaagaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacggacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 39 - DNA, 2214 bp, Unknown
  new AAV serotype, clone rh.69
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgccccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccatcagctacaccttcgaggacgttcccttccacagcagctacgcacacagccagagcctggaccggctgatgaatcctcttatcgaccagtacctgtattacctggccagaacacagagcaacgcaggaggcacagctggcaatcaggaactgcagttttatcagggcgggcctaccaccatggccgaacaagccaaaaactggctgcctggaccttgcttccggcaacaaagagtctccaagacgctggatcaaaacaacaacagcaactttgcttggactggtgccaccaaataccatctaaatggaagaaattcattggttaatcccggtgtcgccatggcaacccacaaggacgacgaggaacgcttcttcccttcgagcggagtcctgatttttggaaaaactggagcagctaataagactacactggaaaatgtgttaatgacaaatgaagaggaaattcgtcctaccaacccggtagccaccgaggaatacgggactgttagcagcaacctgcaggcggctaacactgcagcccagacacaagttgtcaacaaccagggagccttacctggtatggtctggcagaaccgggacgtgtacctgcagggtcccatctgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 40 - DNA, 2214 bp, Unknown
  new AAV serotype, clone rh.54
atggctgctgacggttatcttccagattggctcgaggacaacctctctgagggcattcgcgagtggtgggacctgaaacctggagccccgaaacccaaagccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaacctctcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcgactcatcaacaacaactggggattccggcccaagaagctcaacttcaagctcttcaacatccaagtcaaggaggtcacgacgaatgacggcgtcacgaccatcgctaataaccttaccagcacggttcaggtcttttcggactcggagtaccagctgccgtacgtcctcggctctgcccaccagggctgcctgcctccgttcccggcggacgtcttcatgattcctcagtacggctacctgactctgaacaatggcagccaatcggtgggacgttcatccttctactgcctggaatacttcccttctcaggtgctgagaacgggtaacaacttcaccttcagttacaccttcgaggacgtgcctttccacagcagctacgcgcacagccagagcctagaccggctgatgaatcccctcatcgaccagtacctgtattacctggctagaacacagagtaacccaggaggcacatctggcaatcgggaactgcagttttaccagggcgggccttccaccatggccgaacaagccaagaactggttacctggaccttgcttccggcaacaaagagtttccaaaacactggatcaaaacaacaacagcaactttgcttggactggtgccaccaaatatcacctgaacggcagaaactcattggtgaatcctggtgtcgccatggcaactcacaaggacgacgaggaccgctttttcccatccagcggagtcctgatttttggaaaaactggagcaaccaacaagactacattggaaaacgtgttaatgacaaatgaagaagaaattcgtcctactaatcctgtggccacagaagaatacgggatagtcagcagcaatttacaagcggccaatactgcagcccagacacaagttgtcaacaaccagggagccttacctggcatggtctggcagaaccgggacgtgtacctgcagggtcccatctgggccaaaattcctcacacagacggcaactttcacccgtctccgctgatgggcggctttggactgaagcatccgcctcctcagatcctgatcaaaaacactcctgttcctgctaatcccccggaggtgtttacgcctgccaagtttgcttctttcatcacacagtacagcaccggccaggtcagcgtggagatcgagtgggagctgcagaaggagaacagcaagcgctggaacccagagattcagtatacctccaattttgacaaacagactggtgtggactttgccgttgacagccagggtgtttattctgagcctcgccccattggtactcgttacctcacccgtaatctgtaa

SEQ ID NO: 41 - DNA, 2214 bp, Unknown
  new AAV serotype, clone rh.45
atggctgccgatggttatcttccagattggctcgaggacaacctctctgagggcattcgcgagtggtgggacctgaaacctggagccccgaaacccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccttaccagcacggttcaggtcttttcggactcggaataccagctgccctacgtcctcggctccgcacaccagggctgcctgcctccgttcccggcggacgtcttcatgattcctcagtacggctacctgactctcaacaacggtagtcaggccgtgggacgttcctccttctactgcctggagtacttcccctctcagatgctgagaacgggcaacaacttttccttcagctacactttcgaggacgtgcctttccacagcagctacgcgcacagccagagtttggacaggctgatgaatcctctcatcgaccagtacctgtactacctgtcaagaacccagtctacgggaggcacagcgggaacccagcagttgctgttttctcaggccgggcctagcaacatgtcgactcaggccagaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatccttatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgcttactctgagcctcgccccattggcactcgttacctcacccgtaatctgtaa

SEQ ID NO: 42 - DNA, 2217 bp, Unknown
  new AAV serotype, clone rh.59
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctagaaagagactgaactttgggcagactggcgactcagagtcagtccccgaccctcaaccaatcggagaaccaccagcaggcccctctggtctgggatctggtacaatggctgcaggcggtggcgcaccaatggctgacaataacgagggcgccgacggagtgggtaatgcctcaggaaattggcattgcgattccacatggctgggcgacagagtcatcaccaccagcacccgaacctgggctttgcccacctacaacaaccacctctacaagcaaatctccagtcagtcagcaggtagcaccaacgacaacgtctacttcggctacagcaccccctgggggtattttgacttcaacagattccactgtcacttctcaccacgtgactggcagcggctcatcaacaacaactggggattccggcccaagaagctcaacttcaagctgttcaacatccaggtcaaggaggtcacaacgaatgacggcgtcacgaccatcgccaataaccctaccagcacggttcaggtcttttcggactcggaataccagctgccctacgtcctcggctccgcacaccagggctgcctgcctccgttcccggcggacgtcttcatgattccccagtacggctacctgactctgaacaatggcagccaatcggtgggtcgttcctctttctactgcctggaatatttcccttctcaaatgctgagaacgggcaacaacttcaccttcagctacaccttcgaggacgttcccttccacagcagctacgcacacagccagagcctggaccggctgatgaatcctcttatcgaccagtacctgtattacctggccagaacacagagcaacgcaggaggcacagctggcaatcgggaactgcagttttatcagggcgggcctaccaccatggccgaacaagccaaaaactggctgcctggaccctgctacagacagcagcgcgtctccacgacactgtcgcaaaacaacaacagcaactttgcctggactggtgccaccaagtatcatctgaacggcagagactctctggtgaatccgggcgtcgccatggcaaccaacaaggacgacgaggaccgcttcttcccatccagcggcatcctcatgtttggcaagcagggagctggaaaagacaacgtggactatagcaacgtgatgctaaccagcgaggaagaaatcaagaccaccaaccccgtggccacagaacagtatggcgtggtggctgataacctacagcagcaaaacaccgctcctattgtgggggccgtcaacagccagggagccttacctggcatggtctggcagaaccgggacgtgtacctgcagggtcctatttgggccaagattcctcacacagatggcaactttcacccgtctcctttaatgggcggctttggacttaaacatccgcctcctcagatcctcatcaaaaacactcctgttcctgcggatcctccaacagcgttcaaccaggccaagctgaattctttcatcacgcagtacagcaccggacaagtcagcgtggagatcgagtgggagctgcagaaggagaacagcaagcgctggaacccagagattcagtatacttccaactactacaaatctacaaatgtggactttgctgttaatactgagggtgtttactctgagcctcgccccattggcactcgttacctcacccgtaatctgtaa

SEQ ID NO: 43 - DNA, 2211 bp, Unknown
  new AAV serotype, clone rh.43
atggctgccgatggttatcttccagattggctcgaggacaacctctctgagggcattcgcgagtggtgggacttgaaacctggagccccgaaacccaaagccaaccagcaaaagcaggacgacggccggggcctggtgcttcctggctacaagtacctcggacccttcaacggactcgacaagggggagcccgtcaacgcggcggacgcagcggccctcgagcacgacaaggcctacgaccagcagctcgaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccagtagagcagtcaccccaagaaccagactcctcctcgggcatcggcaagaaaggccaacagcccgccagaaaaagactcaattttggccagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgttttttcccagtaacgggatcctgtttttggcaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctacagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 44 - DNA, 2211 bp, Unknown
  new AAV serotype, clone hu.3
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgcggcctggtttgaggaaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctggacgacagagtcatcgccaccagcacccgaacctgggccctgcccacatacaacaaccacctctacaagcaaatctccagccaatcaggagcctgcaacgacaaccactactttggctacagcaccccctgggggtattttgacttcaacagattccactgccacttttcaccacgtgactggcaaagactcatcaacagcaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcccgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcactgccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaataacaactgcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggcccaccaatcccgtggctacggagcagtacgggactgtgtcaaataatttgcaaaactcaaacactggtccaactacaggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaagcactcccgttccagccaatcctcccacaaacttcagttctgccaagtttgcttcttccatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 45 - DNA, 2208 bp, Unknown
  new AAV serotype, clone hu.5
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcgcaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 46 - DNA, 2208 bp, Unknown
  new AAV serotype, clone hu.1
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatggcggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacggcaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgacgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 47 - DNA, 2208 bp, Unknown
  new AAV serotype, clone hu.4
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggagcctgttaagacggctccgggaaaaaagaggccggtagagcactctcctgtggagccagactcctcctcgggaaccggaaaagcgggccagcagcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcgtcaacaacaaccggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaa

SEQ ID NO: 48 - DNA, 2209 bp, Unknown
  new AAV serotype, clone hu.2
atggctgccgatggttatcctccagattggctcgaggacactctctctgaagggataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccagcggcctgcaagaaaaagattaaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacatacaacaaccacctctacaagcaaatctccagccaatcaggagccagcaacgacaaccactactttggctacagcaccccctgggggtattttgacttcaacagattccactgccacttttcaccacgtgactggcaaagactcatcaacaacaactggggattccggcccaaaagactcaacttcaagctctttaatattcaagtcaaagaggtcacgcagaatgacggtacgacgacgattgccaataaccttaccagcacggttcaggtgtttactgactcggagtaccagctcccgtacgtcctgggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggaccaaccaacatgtctcttcaagctaaaaactggctgcctggaccttgctacagacagcagcgtctgtcaaaacaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcagggccaccaatcccgtggctacggagcagtacgggactgtgtcaaataatttgcaaaactcaaacactggtccaactactggaactgtcaatcgccaaggagcgttacctggtatggtgtggcaggatcgagacgtgtacctgcagggacccatttgggccaagattcctcacaccgatggacactttcatccttctccactgatgggaggttttggactcaaacacccgcctcctcagatcatgatcaaaaacactcccgttccagccaatcctcccacaaacttcagttctgccaagtttgcttctttcatcacacagtattccacgggacaggtcagcgtggagatcgagtgggagctgcagaaggagaacagcaaacgctggaatcccgaaattcagtacacttccaactacaacaagtctgttaatgtggactttactgtggacactaatggtgtgtattcagagcctcgccccattggcaccagatacctgactcgtaatctgtaat

SEQ ID NO: 49 - DNA, 2208 bp, Unknown
  new AAV serotype, clone hu.25
atggctgccgatggttatcttccagattggctcgaggacactctctctgaaggaataagacagtggtggaagctcaaacctggcccaccaccaccaaagcccgcagagcggcataaggacggcagcaggggtcttgtgcttcctgggtacaagtacctcggacccttcaacggactcgacaagggagagccggtcaacgaggcagacgccgcggccctcgagcacgacaaggcctacgaccggcagctcaacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagagaccggtagagcactctcctgcggagccagactcctcctcgggaaccggaaaagcgggccagcagcctgcaagaaagagattgaattttggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcaggaaattggcattgcgattcccaatggctgggcgacagagtcatcaccacaagcactcgaacctgggccctgcccacctacaacaaccacctctacaagcaaatctccagccaatcaggagcctcaaacgacaaccactattttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcggacgtcttcatggtcccacagtatggatacctcaccctgaacaacgggagtcaggcggtaggacgctctcccttttactgcctggagtactttccttctcagatgctgcgtactggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaaccctgatatttggtaaacaaggaacaaatgccaacgacgcggatttggaaaatgtcatgattacagatgaagaagaaatcaggaccaccaatcccgtggctacggagcagtacgggactgtgtcaaataatttgcaaaactcaaacactggtccaactactggaactgtcaatcaccaaggagcgttacctggtatggtgtggcaggatcgagatgtgtaccttcagggacccatttgggccaagattcctcacaccgatggacactttcatccttctccactgatgggaggttttggactcaaacacccgcctcctcagattatgatcaaaaacactcccgttccagccaatcctcctacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacaataatggcgtgtactcagagcctcgccccattggcaccagatacctgactcgtaatctgtaa

SEQ ID NO: 50 - DNA, 2208 bp, Unknown
  new AAV serotype, clone hu.15
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactctacaagggagagccggtcgacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggccaaaaagagggttcttgaacctctgggcttggttggggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaataaccacctctacaagcaaatctccagccaatcaggagcctcaaacgacaaccactactttggctacagcaccccctgggggtattttgacttcaacagattccactgccacttttcaccacgtgaccggcaaagactcatcaacaacaactggggattccgaccaaaaagactcaacttcaagctctttaacattcaagtcaaagaggtcacgcagaatgacggtacgacgacgattgccaataaccttaccagcacggttcaggtgtttactgactcggggtaccagctcccgtacgtcctcggcttggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtggagatcgagtgggagctgcagaaggaggacagcaaacgctggaaccccgagatccagtacacttccaactataacaaacctgttaatgtggactttactgtggacactaatggtgtgtattcagagcctcgccccattggcaccagatacctgactcgtaatctgtaa

SEQ ID NO: 51 - DNA, 2208 bp, Unknown
  new AAV serotype, clone hu.16
atggctgccgatggttatcttccagattggctcgaggacactctctctgaaggaataagacagtggtggaagctcaaacctggcccaccaccgccaaagcccgcagagcggcataaggacgacagcaggggtcttgtgcttcctgggtacaagtacctcggacccttcaacggactctacaagggagagccggtcaacgaggcagacgccgcggccctcgagcacgacaaggcctacgaccggcagctcgacagcggagacaacccgtacctcaagtacaaccacgccggcgcggagtttcaggagcgccttaaagaagatacgtcttttgggggcaacctcggacgagcagtcttccaggccaaaaagagggttcttgaacctctgggcttggttgaggagcctgttaaaacggctccgggaaaaaagaggccggtagagcactctcctgtggagccagactcctcctcgggaaccggaaaagcgggcaaccagcctgcaagaaaaagattgaattttggtcagactggagacgcagactccgtacctgacccccagcctctcggacagccaccagcagccccctctggtctgggatctactacaatggctacaggcagtggcgcaccagtggcagacaataacgagggtgccgatggagtgggtaattcctcaggaaattggcattgcgattcccaatggctgggcgacagagtcatcaccaccagcacccgaacctgggctctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgaccaaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgctgcgtactggaaacaactttcagttcagctacacctttgaagacgttcctttccacagcagctacgctcacagccagagtctggatcggctgatgaatcctctgatcgaccagtacctgtattatctgaacaagacacaatcaaatagtggaacccttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaagactcaaatactggtccaactactggaactgtcaatcaccaaggagcgttacctggtatggtgtggcaggatcgagacgtgtacctgcagggacccatttgggccaagattcctcacaccgatggacactttcatccttctccacttatgggaggttttggactcaaacacccacctcctcagatcatgattaaaaacactcccgttccagccaatcctcccacaaacttcagttctgccaagtttgcttctttcatcacacagtattccacgggacaagtcagcgtagagatcgagtgggagctgcagaaggagaacagcaaacgctggaaccccgagatccagtacacttccaactataacaaatctgttaatgtggactttactgtggacactaatggtgtgtattcagagcctcgccccattggcaccagatacctgactcgtaatctgtaa

SEQ ID NO: 52 - DNA, 2208 bp, Unknown
  new AAV serotype, clone hu.18
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgaaagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggagcctgttaaaacggctccgggaaaaaagaggccggtagagcactctcctgtggagccagactcctcctcgggaaccggaaaagcgggccagcagcctgcgagaaaaagattgaattttggtcagactggagacgcagactccgtacctgacccccagcctctcggacagccaccagcagccccctctggtctgggatctactacaatggcttcaggcagtggcgcaccagtggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacagctggggattccgacccaaaagactcaacttcaagctctttaacattcaagtcaaagaggtcacgcagaatgacggtacgacgacgattgccaataaccttaccagcacggttcaagtgtttaccgactcggagtaccagctcccgtacgtcctcggctcggcgcatcaaggatgcctcccgccgttcccagcagacgtctttatggtcccacagtatggatacctcaccctgaacaacgggagtcaggcggtaggacgctcttccttttactgcctggagtactttccttctcagatgctgcgtactggaaacaactttcagttcagctacacctttgaagacgttcccttccacagcagctacgctcacagccagagtctggatcggctgctgaatcctctgatcgaccagtacctatattatctgaacaagacacaatcaaatagtggaactcttcagcagtctcggctactgtttagccaagctggacccaccagcatgtctcttcaagctaaaaactggctgcctggaccttgctacagacagcagcgtctgtcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggtatggtgtggcaggatcgagacgtgtacctgcagggacccatttgggccaagattcctcacacggacgggcactttcatccttctccactaatgggaggttttgggctcaaacacccgcctcctcagatcatgatcaaaaacactcccgttccagccaatcctcctacaaacttcagttcttccaagtttgcttctttcatcacacagtattccacggggcaggtcagcgtggagatcgagtgggagctgcagaaggagaacagcaaacgctggaatcccgaaattcagtatacttccaactacaacaaatctgttaatgtggactttactgtggacactaatggtgtgtattcagagcctcgccccattggcaccagatacccgactcgtaatctgtaa

SEQ ID NO: 53 - DNA, 2208 bp, Unknown
  new AAV serotype, clone hu.8
atggctgccgatggttatcttccagattggctcgaggacactctctctgaaggaacaagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 54 - DNA, 2208 bp, Unknown
  new AAV serotype, clone rh.56
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcttcaggaaattggcattgcgattcccaatggctgggcgacagagtcatcaccaccagcacccgaacctgggcccagcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggagctcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtaccacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccgaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 55 - DNA, 2208 bp, Unknown
  new AAV serotype, clone hu.7
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgagggacctgttaagacggctccgggaaaaaagaggccggtagagcactctcctgcggagccagactcctcctcgggaaccggaaaagcgggccagcagcctgcaagaaaaagattgaattttggtcagactggagacgcagactccgtacctgacccccagcctctcggacagccaccagcagccccctctggtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctcaagccaatcaggagcctcaaacgacaaccactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcgggtcggcgcatcaaggatgcctcccgccgtttccagcggacgtcttcatggtcccacagtatggatacctcaccctgaacaacgggagtcaggcggtaggacgctcttccttttactgcctggagtactttccttctcagatgcttcgtactggaaacaactttcagttcagctacacctttgaagacgttcctttccacagcagctacgctcacagccagagtctggatcggctgatgaatcctctgatcgaccagtacctgtattatctgaacaaaacacaatcaaatagtggaactcttcagcagtctcggctactgtttagtcaagctggacccaccagcatgtctcttcaagctaaaaactggctacctggaccttgctacagacagcagcgtctgtcaaagcaggcaaacgacaacaacaacagcaactttccctggactgcggctacaaagtatcacctaaatggccgggactcgttggttaatccaggaccagctatggccagtcacaaagacgatgaagaaaagtttttccccatgcatggaaccctgatatttggtaaacaaggaacaaatgctaacgacgcggatttggacaatgtcatgattacagatgaagaagaaatccgcaccaccaatcccgtggctacggagcagtacggatatgtgtcaaataatttgcaaaactcaaatactggtccaactactggaactgtcaatcaccaaggagcgttacctggcatggtgtggcaggatcgagacgtgtacctgcagggacccatttgggccaagattcctcacaccgatggacactttcatccttctccactgatgggaggttttgggctcaaacacccgcctcctcagatcatgatcaaaaacactcccgttccagccaatcctcccacaaacttcagttctgccaagtttgcttctttcatcacacagtattccacggggcaggtcagcgtggagatcgagtgggagctgcagaaagagaacagcaaacgctggaatcccgaaattcagtacacttccaactacaacaaatctgttaatgtggactttactgtggacactaatggcgtgtattcagagcctcgccccattggcaccagatacctgactcgtaatctgtaa

SEQ ID NO: 56 - DNA, 2208 bp, Unknown
  new AAV serotype, clone hu.10
atggctgccgatggttatcttccagattggctcgaggacactctctctgaaggaataagacagtggtggaagctcaaacctggcccaccaccaccaaagctcgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccatcagcctgcgagaaagagattgaattttggtcagactggagacgcagactccgtacctgacccccagcctctcggacagccaccagcagcccccacaagtctgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcacggtcccacagtatggatacctcaccctgaacaacgggagtcaggcggtaggacgctcttccttttactgcctggagtactttccttctcagatgctgcgtactggaaacaaccttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaactacagttctgccaagtttgcttctttcatcacacagtattccacgggccaggtcagcgtggagattgagtgggagctgcggaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 57 - DNA, 2208 bp, Unknown
  new AAV serotype, clone hu.11
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcgtctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 58 - DNA, 2208 bp, Unknown
  new AAV serotype, clone hu.9
atggctgccgatggttatcttccagattggctcgaggacactctctctgaaggaataagacagtggtggaagctcaaacctggcccaccaccaccaaagcccgcagagcggcatcaggacaacagcaggggtcttgtgcttcctgggtacaagtacctcggaccctccaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctgcagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtacccgctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtaccggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatggaaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagccttgccccattggcaccagatacctgactcgtaatctgtaa

SEQ ID NO: 59 - DNA, 2208 bp, Unknown
  new AAV serotype, clone hu.12
atggctgccgatggttatcttccagattggctcgaggacactctctctgaaggaataagacagtggtggaagctcaaacctggcccaccaccaccaaagcccgcagagcggcatcaggacgacagcaggggtcttgtgcttcctgggtacaagtacctcggacccttcaacggactcgacaaaggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggccatcagcctgcgagaaagagattgaattttggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctctacaagcaaatctccagccaatcaggagcctcgaacgacaaccactactttggctacagcaccccctgggggtattttgacttcaacagattccactgtcacttctccccacgtgattggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgcccttccttttactgcctggagtactttccttctcagatgctgcgtactggaaacaactttaccttcagctacacctttgaggacgttcctttccacagcagctacgctcacagccagagtttggaccggctgatgaatcctctgatcgaccagtatctatattatctgaacaggacacaatcaaatagtggaactcttcagcagtctaggctactgtttagccaagctggacccaccagcatgtctcttcaagctaaaaactggctgcctggaccttgctacagacagcagcgtctttcaaagcaggcaaacgacaacaacaacagcaactttccctggactgcggctacaaagtatcatctaaatggccgggactcgttggttaatccaggaccagctatggccagccacaaagacgatgaagaaaagtttttccccatgcatgggaccctgatatttggtaaacaaggaacaaatgctaacgacgcggatttggagcatgttatgattacagatgaagaagaaatcaggaccaccaatcctgtggctacagagcagtacggaaacgtgtcaaataatttgcaaaactcaaatactggtccaactacagaaaatgtcaatcaccagggagcgttacctggtatggtgtggcaggatcgagacgtgtacctgcagggacccatttgggccaagattcctcacaccgacggacactttcacccttctccactgatgggaggttttggactcaaacacccgcctcctcaaatcatgatcaaaaacactcccgttccagccaatcctcccacaaacttcagttctgccaagtttgcttctttcatcacacagtattccacgggccaggtcagcgtggagattgagtgggagctgcagaaggagaacagcaaacgctggaaccccgagatccagtatacttccaactacaacaaatctgttaatgtggactttactgtggacactaatggtgtgtattcagagcctcgccccattggcaccagatacctgactcgtaatctgtaa

SEQ ID NO: 60 - DNA, 2208 bp, Unknown
  new AAV serotype, clone hu.23
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctgcaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtattttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctacctacctccagagcggcaacacacaagcagctacctcagatgtcaacacacaaggcgttcttccaggcatggtctggcaggacagagacgtgtacctgcgggggcccatctgggcaaagattccacacacggacggacattttcacccctctcccctcatgggcggatttggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 61 - DNA, 2208 bp, Unknown
  new AAV serotype, clone hu.26
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 62 - DNA, 2208 bp, Unknown
  new AAV serotype, clone hu.19
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggagaaaagaggccggtagagcactctcctgcggagccagactcctcctcgggaaccggaaaagcgggccagcagcctgcaagaaagagattgaattttggccagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggtattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcgtgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 63 - DNA, 2208 bp, Unknown
  new AAV serotype, clone hu.20
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaggtacctcggacccttcaacggactcgacaagggagagccggtcaacgaggcagacgccgcggccctcgagcacgacaaggcctacgaccggcagctcgacagcggagacaacccgtacctcaagtacaaccacgtcgacgcggagtttcaggagcgtcttaaagaagatacgtcttttgggggcaacctcggacgagcagtcttccaggccaaaaagaggattcttgaacctctgggcctggttgaggaacctgttaaggcggctccgggagaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggcattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctccccccatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcgccagatacctgactcgtaatctgtaa

SEQ ID NO: 64 - DNA, 2208 bp, Unknown
  new AAV serotype, clone hu.27
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtatttcgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgccttccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacggccaaagtctggaccgtctcatgaatcctctcatcgaccagtacctgtattacttgagcagaacaaacactccaagcggaaccaccacgatgtccaggcttcagttttctcaggccggagcaagtgacgttcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcgtctttggaaaacaagactcgggaaaaactaatgtggacattgaaaaggttatgattacagacgaagaggaaatcaggaccaccaatcccgcggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgtttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 65 - DNA, 2208 bp, Unknown
  new AAV serotype, clone hu.21
atggctgccgatggttatcttccagattggctcgaggacaccctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagataacccgtacctcaagtacaaccacgccgacgcggagtttcaggagcgccttaaagaggatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccggcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagatgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 66 - DNA, 2208 bp, Unknown; identical to SEQ ID NO: 65
  new AAV serotype, clone hu.24

SEQ ID NO: 67 - DNA, 2208 bp, Unknown
  new AAV serotype, clone hu.22
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaaggagatacgtcttttgggggcaacctcggacgagcagtcttccaggccaaaaagaggattcttgaacctctgggcctggttgaggaacctgttaagacggctccgggaaaaaagaggccggtagagcactctcctgcggagccagactcctcctcgggaaccggaaaagcgggccagcagcctgcaagaaagagattgaattttggtcagactggagacgcagactcagtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcggcagagtcatcaccaccagcacccgcacctgggccctgcccacctacaacaaccatctgtacaagcaaatctccagccagtctggagccagcaacgacaaccactactttggctacagcaccccctgggggtattttgacttcaacagattccactgccacttctccccacgtgactggcaaagactcatcaacaacaactggggattccggcccaagagactcagcttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacggcagtcaggcggtaggacgctcttccttttactgcctggagtactttccttctcagacgcttcgtaccggaaacaactttaccttcagctacacctttgaagacgttcctttccatagcagctacgctcacagccaaagtctggaccgtctcatgaatcctctcatcgaccagtacctgtattacttgagcagaacaaacactccaagcggaaccaccacgatgtccaggcttcagttttctcaggccggagcaagtgacattcgggaccagtctagaaactggcttcctggaccctgttaccgccagcagcgagtatcaaagacagctgcggacaacaacaacagtgattactcgtggactggagctaccaagtaccacctcaatggaagagactctctggtgaatccgggcccagctatggccagccacaaggacgatgaagaaaaatattttcctcagagcggggttctcatctttggaaaacaagactcgggaaaaactaatgtggacattgaaaaggttatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacaaattctcatcaagaacaccccggtacctgcgaatccttcgaccactttcagtgcggcaaagtttgcttccttcatcacacagtactccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaa

SEQ ID NO: 68 - DNA, 2208 bp, Unknown
  new AAV serotype, clone hu.28
atggctgccgatggttatcttccagattggctcgaggacactctctctgaaggaataagacagtggtggaaactcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttctggaacctctgagcctggttgaggagcctgttaagacggctccgggaaaaaagaggccggtagagcactctcccgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcaggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtcgggcaagacagagacgtgtacctgcaggggcctacttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 69 - DNA, 2208 bp, Unknown
  new AAV serotype, clone hu.29
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcagagtttcaggagcgccttaaagaagatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagggtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttttttcctcagagcggggttcttatctttgggaagcaaggcccagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 70 - DNA, 2208 bp, Unknown
  new AAV serotype, clone hu.30
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaggatacgtcttttgggggcaacctcggacgagcagtcttccaggcaaaaaagagggttctggaacctctgggcctggttgaggagcctgttaagacggctccgggaaaaaagaggccggtagagcactctcctgcagagccagattcctcctccggaactggaaagtcgggcaaccagcctgcaagaaagagattgaatttcggtcagactggagactcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccatctgtacaagcaaatatccagccagtctggagccagcaacgacaatcactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctagagtactttccttctcagatgctgcgtaccggaaacagctttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggaccagtctaggaactggcttcctggaccctgttaccgtcagcagcgagtatcaaagacatctgcggataacaacaacagtgaatactcgtggactggagctaccaagtaccacctcaatggcagagactctctggtgaatccgggcccggccatggccagccacaaagacgatgaagaaaagttctttcctcagagcggggttcttatctttgggaagcaaggctcagagaaaacaaatgtggatattgaaaaggtcatgattacagacgaagaggaaatcaggaccaccaatcccgtggctacggagcagtatggttctgtatctaccaacctccagagcggcaacacacaagcagctaccgcagatgtcaacacacaaggcgttcttccaggcatggtctggcaagacagagacgtgtacctgcaggggcctatttgggcaaagattccacacacggacggacattttcacccctctcccctcatgggcggatttggacttaaacaccctcctccacagattctcatcaagaacaccccggtacctgcgaatccttcgaccaccttcagtgcggcaaagtttgcttccttcattacacagtactccacggggcaggtcagcgtggagatcgagtgggagctgcagaaggagaacagcaaacgctggaatcccgagatccagtacacttccaactacaacaagtctgttaatgtggactttactgtggacactaatggcgtgtattcagagcctcgccccattggcaccagatacctgactcgtaatctgtaa

SEQ ID NO: 71 - DNA, 2208 bp, Unknown
  new AAV serotype, clone hu.13
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggagcctgttaaaacggctccgggaaaaaagaggccggtagagcactctcctgcggagccagactcctcctcgggaaccggaaaagcgggccagcagcctgcaagaaaaagattgaatttcggtcagactggagacgcagactccgtacctgacccccagcctctcggacagccaccagcagccccctctggtctgggaactaatacgatggcttcaggcagtggcgcaccaatggcagacaataacgagggcgccgacggagtgggtaattcctcgggaaattggcattgcgattccacatggatgggcgacagagtcatcaccaccagcacccgaacttgggccctgcccacctacaacaaccatctctacaagcaaatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggccagccacaaggacgatgaagaaaagttttttcctcagagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctgcagggcggcaacacacaagcagctaccgcagatgtcaacacacaaggcgttcttccaggcatggtctggcaggacagagacgtgtacctgcaggggcccatctgggcaaagattccacacacggacggacattttcacccctctcccctcatgggcggattcggacttaaacaccctcctccacagattctcatcaagaacaccccggtacctgcgaatccttcgaccaccttcagtgcggcaaagtttgcttctttcatcacacagtattccacggggcaggtcagcgtggagatcgagtgggagctgcagaaggagaacagcaaacgctggaatcccgagatccagtacacttccaactacaacaaatctgttaatgtggactttactgttgacactaatggcgtgtattcagagcctcgccccattggcaccagatacctgactcgtaatctgtaa

SEQ ID NO: 72 - DNA, 2208 bp, Unknown
  new AAV serotype, clone hu.34
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcctttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgagagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 73 - DNA, 2208 bp, Unknown
  new AAV serotype, clone hu.35
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtaccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 74 - DNA, 2208 bp, Unknown
  new AAV serotype, clone hu.36
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtactcgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagcaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtccgttaatgtggactttactgtggacactaatggcgtgtattcagagcctcgccccattggcaccagatacctgactcgtaatctgtaa

SEQ ID NO: 75 - DNA, 2208 bp, Unknown
  new AAV serotype, clone hu.33
atggctgccgatggttatcttccagattggctcgaggacactctctctgaaggaataagacagcggtggaagctcaaacctggcccaccaccaccagagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggtacttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccggcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctgggccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 76 - DNA, 2208 bp, Unknown
  new AAV serotype, clone hu.45
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggggtaccagctcccgtacgtcctcggctcggcgcatcaaggatgcctcccgccgttcccagcagacgtcttcatggtgccacagtatggataccccaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccgtggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 77 - DNA, 2208 bp, Unknown
  new AAV serotype, clone hu.47
atggctgccgatggctatcttccagattggctcgaggacactctctctgaaggaataagacagtggtggaagctcaaacctggcccaccaccaccaaagcccgcagagcggcatagggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacagtcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggctccagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 78 - DNA, 2211 bp, Unknown
  new AAV serotype, clone hu.48
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggccagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtacttcaacgggggccagcaacgacaaccactacttcggctacggcaccccctgggggtattttgatttcaacagattccactgccacttttcaccacgtgactggcagcgactcatcaacaacaattggggattccggcccaagagactcaacttcaaactcttcaacatccaagtcgaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaacacaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcaccgctgtggcctcacacaaagacgacgaagacaagttctttcccatgagcggtgtcatgatttttggaaaagagagcgccggagcttcaagcactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 79 - DNA, 2211 bp, Unknown
  new AAV serotype, clone rh.71
atggctgccgatggttatcttccagattggctcgaggacaacctctctgagggcattcgcgagtggtgggacttgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaaacgtccggtagagcagtcgccacaagagccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacctgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 80 - DNA, 2214 bp, Unknown
  new AAV serotype, clone hu.43
atggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacccgcggtataaccacgccgacgccgagtttcaggagcgtctgcaagaagatacgccttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctctccacagcagctacgcgcacagccagagcctggaccggctgatgaatcctctcatcgtccaatacctgtattacctgaacagaactcaaaatcagtccggaagtgcccaaaacaaggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccagcgttgattttactgtggacaacaatggactttatactgagcctcgccccattggcacccgttaccttacccgtcccctgtaa

SEQ ID NO: 81 - DNA, 2211 bp, Unknown
  new AAV serotype, clone hu.44
atggctgccgatggttatcttccagattggctcgaggacactctctctgaaggaataagacagtggtggaagctcagacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgagcagtcttccaggccaagaagcgggttctcgaacctctcggtctggttgaggaaggcgctgagacggctcctggaaagaaacgtccggtagagcagtcgccacaagggccagactcctcctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggctgcctccctccgttcccggcggacgtgttcatgattccgcaatacggctacctgacgctcaacaatggcagccaagccgtgggacgttcatccttttactgcctggaatatttcccttctcagatgctgagaacgggcaacaactttaccttcagctacacctttgaggaagtgcctttccacagcagctacgcgcacagccagagcctggaccggctgatgaatcctctcatcgaccaatacctgtattacccgaacagaactcaaaatcagtccggaagtgcccaaaacaaggacttgctgtttagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaaggtagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccacaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 82 - DNA, 2211 bp, Unknown
  new AAV serotype, clone hu.46
atggctgccgacggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcgggcgggcagtcttccaggccaagaagcgggttctcgaacctctcggtctggttgaggaaggcgctaagacggctcctggaaagaaacgtccggtagagcagtcgccacaagagccagactccccctcgggcatcggcaagacaggccagcagcccgctaaaaagagactcaattttggtcagactggcgactcagagtcagtccccgatccacaacctctcggagaacctccagcaacccccgctgctgtgggacctactacaatggcttcaggcggtggcgcaccaatggcagacaataacgaaggcgccgacggagtgggtaatgcctcaggaaattggcactgcgattccacatggctgggcgacagagtcatcaccaccagcacccgcacctgggccttgcccacctacaataaccacctctacaagcaaatctccagtgcttcaacgggggccagcaacgacaaccactacttcggctacagcaccccctgggggtattttgatttcaacagattccactgccacttttcaccacgtgactggcagcgactcatcaacaacaattggggattccggcccaagagactcaacttcaaactcttcaacatccaagtcaaggaggtcacgacgaatgatggcgtcacaaccatcgctaataaccttaccagcacggttcaagtcttctcggactcggagtaccagcttccgtacgtcctcggctctgcgcaccagggccgcctccctccgttcccggcggacgtgttcatgattccgcaatacggctacctgacgctcaacaatggcagccaagccgtgggacgttcatcctcttactgcctggaatatttcccttctcagatgctgagaacgggcaacaactttaccttcagctacacctttgaggaagtgcctctccacagcagctgcgcgcacagccagagcctggaccggctgatgaatcctctcatcgaccaatacctgtattacctgaacagaactcaaaatcagtccggaagtgcccaaaacagggacttgctgttcagccgtgggtctccagctggcatgtctgttcagcccaaaaactggctacctggaccctgttatcggcagcagcgcgtttctaaaacaaaaacagacaacaacaacagcaattttacctggactggtgcttcaaaatataacctcaatgggcgtgaatccatcatcaaccctggcactgctatggcctcacacaaagacgacgaagacaagttctttcccatgagcggtgtcatgatttttggaaaagagagcgccggagcttcaaacactgcattggacaatgtcatgattacagacgaagaggaaattaaagccactaaccctgtggccaccgaaagatttgggaccgtggcagtcaatttccagagcagcagcacagaccctgcgaccggagatgtgcatgctatgggagcattacctggcatggtgtggcaagatagagacgtgtacctgcagggtcccatttgggccaaaattcctcacacagatggacactttcacccgtctcctcttatgggcggctttggactcaagaacccgcctcctcagatcctcatcaaaaacacgcctgttcctgcgaatcctccggcggagttttcagctacaaagtttgcttcattcatcacccaatactccgcaggacaagtgagtgtggaaattgaatgggagctgcagaaagaaaacagcaagcgctggaatcccgaagtgcagtacacatccaattatgcaaaatctgccaacgttgattttactgtggacaacaatggactttatactgagcctcgccccattggcacccgttaccttacccgtcccctgtaa

SEQ ID NO: 83 - protein, 738 aa, Unknown
  vp1, clone hu.17
MAADGYLPDWLEDNLSEGIREWWDLKPGAPKPKANQQKQDDGRGLVLPGCKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYNKSVNVDFTVDTNGVYSEPRPIGTRYLTRNL

SEQ ID NO: 84 - protein, 738 aa, Unknown
  vp1, clone hu.6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKTGQQPAKKRLNFGQTGDSESVPDPQPIGEPPAGPSGLGSGTMAAGGGAPMADNNEGADGVGSSSGNWHCDSAWLGDRVITTSTRPWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCPPPFPADVFMIPQYGYLTLNNGSQAVGRSSFYCLEYFPSQMRRTGNNFEFSYQFEDVPFHSSYAHSQSLDRLMNPLIDQYLYYLSRTQSTGGTAGTQQLLFSQAGPNNMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 85 - protein, 738 aa, Unknown
  vp1, clone hu.42
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQSNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGLGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 86 - protein, 738 aa, Unknown
  vp1, clone rh.38
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQRPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKPFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLHYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 87 - protein, 738 aa, Unknown
  vp1, clone hu.40
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLSFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNSEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 88 - protein, 738 aa, Unknown
  vp1, clone hu.37
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 89 - protein, 738 aa, Unknown; identical to SEQ ID NO: 88
  vp1, clone rh.39

SEQ ID NO: 90 - protein, 738 aa, Unknown; identical to SEQ ID NO: 88
  vp1, clone AAV4407

SEQ ID NO: 91 - protein, 738 aa, Unknown
  vp1, clone hu.41
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGPVEEAAKTAPGKKRPVEPPPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTVANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 92 - protein, 738 aa, Unknown
  vp1, clone rh.40
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQDEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSARAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQANTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNSEGTYSEPRPIGTRYLTRNL

SEQ ID NO: 93 - protein, 731 aa, Unknown
  vp1, clone pi.1
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGQTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVSPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 94 - protein, 731 aa, Unknown
  vp1, clone pi.3
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGQQPAKKRLNFGPTGDSESVPDPQPLSEPPAGPSGLGSGTMAAGGGAPMADNNEGADGVGNVSGNWHCDSTWLGDRVITTSTRTWALPTYNNHLYKQISNGTSGGSSNDNTYFGYSTPWGYFDFNRFHCHFSPRDWQRLINNNWGFRPKKLNFKLFNIQVKEVTQNEGTKTTANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTAVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 95 - protein, 731 aa, Unknown
  vp1, clone pi.2
MAADGYLPDWLEDNLSEGIREWWALKPGAPQPKANQQKQDDGRGLVLPGYKYLGPFNGLDKGEPVNEADAAALEHDKAYDQQLKAGDNPYLRYNHADAEFQERLQEDTSFGGNLGRAVFQAKKRVLEPLGLVEEGAKTAPGKKRPVEPDSSSGIGKSGRQPAKKRLNFGQTGDSESVPDPQPLSEPPAGPSGLGSGTMAAGGGAPMADNNEGADGVGNASGNWHCDSTWLGDRVITTSTRTWALPTYNNHLYKQISNGTSGGSSNDNTYFGYSTPWGYFDFNRFHCHFSPRDWQRLINNNWGFRPKRLNFKLFNIQVKEVTQNEGTKTIANNLTSTVQVFTDSKYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSRTQTNGTNATQTLLFAQAGPQNMSAQAKNWLPGPCYRQQRVSTTVSQNNNSNFTWTGATKYHLNGRDSLVNPGVAMATHKDDEERFFPSSGVLMFGKQGAGKDNVEYTNVMLTSEEEIKTTNPVATEQYGVVADNLQQTNSAPIVGAVNSQGALPGMVWQNRDVYLQGPIWAKIPHTDGNFHPSPLMGGFGLKHPPPQILIKNTPVPADPPVNFTDAKLASFITQYSTGQVSVEIEWELQKENSKRWNPEIQYTSNYYKSANVDFAVNADGVYSEPRPIGTRYLTRNL

SEQ ID NO: 96 - protein, 738 aa, Unknown
  vp1, clone rh.52
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANSLTSTIQVFTDSEYQLPYVLGSAHQGCLPPFPADVFMIPQYGYLTPNNGSQAVGRSSFYCLEYFPSQMLRTGNNFSFSYTFEDVPFHSSYAHSQSLDRLMNPLIDQYLYYLSRTQSTGGTAGTQQLLSSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 97 - protein, 738 aa, Unknown
  vp1, clone rh.53
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYVHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNSGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYPTRNL

SEQ ID NO: 98 - protein, 738 aa, Unknown
  vp1, clone rh.70
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPAYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLSGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSSITQYSTGQVSVEIEWELQKENSKRWNPEIQYTSNYYKSTNVDFAVNTEGVYSEPRPIGTRYLTRNL

SEQ ID NO: 99 - protein, 738 aa, Unknown
  vp1, clone rh.64
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIVWELQKENSKRRNPEIQYTSNYYKSTNVDFAVNTEGVYSEPRPIGTRYLTRNL

SEQ ID NO: 100 - protein, 738 aa, Unknown
  vp1, clone rh.68
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPPSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVVIEWELQKENSKRWNPEIQYTSNYYKSTNVDFAVNTEGVYSELRPIGTRYLTRNL

SEQ ID NO: 101 - protein, 738 aa, Unknown
  vp1, clone rh.46
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKATNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 102 - protein, 738 aa, Unknown
  vp1, clone hu.39
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGRTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYLDFNRFHCHFSPRDWQRLINNNWGFRPKRLSFKLFNIQVKEVTQNEGTKTIANNLASTIQVFTDSEYQPPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSRAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPTVGAVNSQGALPGMVWQNRDVYLQGPIWAKIPHTDGNFHPSPLMGGFGLKHPPPQILIKNTPVPADPPTAFNQAKLNSFIAQYSTGQVSVEIEWELQKENSKRWNPEIQYTSNYYKSTNADFAVNTEGVYSEPRPIGTRYLTRNL

SEQ ID NO: 103 - protein, 738 aa, Unknown
  vp1, clone rh.49
MAADGYLPDWLEDNLSEGIREWWDLKPGAPKPKANQQKQDDGRGLVLPGYKYLGPFNGLDKGEPVNAADAAALEHDKAYDQQLKAGDNPHLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQLIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGNLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNMGYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYGTGQVSVEIEWELQKENSKRWNPEIQYTSNYYKSTNVDFAVNTEGVYSEPRPIGTRYLTRNL

SEQ ID NO: 104 - protein, 738 aa, Unknown
  vp1, clone rh.51
MVADGYLPDWLEDNLSEGIREWWDLKPGAPKPKANQQKQGDGRGLVLPGYKYLGPFNGLDKGEPVNAADAAALEHDKAYDQQLKAGDNPYLRYNHADAELQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCQPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWEPQKENSKRWNPEIQYTSNYYKSTNVDFAVNTEGVYSEPRPIGTRYLTRNL

SEQ ID NO: 105 - protein, 738 aa, Unknown
  vp1, clone rh.57
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQTSNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSAEIEWELQKENSKRWNPEIQYTSNYYKSTNVDFAVNTEGVYSEPRPIGTRYLTRNL

SEQ ID NO: 106 - protein, 738 aa, Unknown
  vp1, clone rh.58
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKCWNPEIQYTSNYYKSTNVDFAVNTEGVYSEPRPIGTRYLTRNL

SEQ ID NO: 107 - protein, 738 aa, Unknown
  vp1, clone rh.61
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRPINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYPFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQDTAPIVGAVNSQGALPGMVWQNRDVYLQGPIWAKIPHTDGNFHPSPLMGGFGLKHPPPQVLIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 108 - protein, 738 aa, Unknown
  vp1, clone rh.50
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPAGKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLVDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWSPEIQYTSNYYKSTNVDFAVNTEGVYSEPRPIGTRYLTRNL

SEQ ID NO: 109 - protein, 737 aa, Unknown
  vp1, clone rh.45
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSTQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGAYSEPRPIGTRYLTRNL

SEQ ID NO: 110 - protein, 738 aa, Unknown
  vp1, clone rh.59
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNPTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 111 - protein, 737 aa, Unknown
  vp1, clone rh.44
MAADGYLPDWLEDNLSEGIREWWDLKPGAPKPKANQQKQDDGRGLVLPGYKYLGPFNGLDKGEPVSAADAAALEHDKACDQRLKAGDNPYLRYNHADAEFQERLQEDTSFGGNLGRAVFQAKKRVLEPLGLVEEAAKTAPGKKGPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDEQTGVDFAVDSQGVYSEPRPIGTRYLTRNL

SEQ ID NO: 112 - protein, 737 aa, Unknown
  vp1, clone rh.65
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPRPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 113 - protein, 737 aa, Unknown
  vp1, clone rh.67
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVLQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 114 - protein, 737 aa, Unknown
  vp1, clone rh.62
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLAEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTGDGVTTIANNLTSTVQVFSDSEYQLPYVLGSAHQGCLPPFPADVFMIPQYGYLTLNNDSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 115 - protein, 737 aa, Unknown
  vp1, clone rh.48
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNKGADGVGNASGNWHCDSTWLGDRVITTSTRTWALPTYNNHLYKQISSQSAGSTNDNVYFGYSTPWGYFDFNRFHCHFSPRDWQRLINSNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 116 - protein, 737 aa, Unknown
  vp1, clone rh.54
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPLGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQVLRTGNNFTFSYTFEDVPFHSSYAHSQSLDRLMNPLIDQYLYYLARTQSNPGGTSGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 117 - protein, 737 aa, Unknown
  vp1, clone rh.55
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTRLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQRRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 118 - protein, 738 aa, Unknown
  vp1, clone rh.47
MAADGYLPDWLEDNLSEGIREWWDLKPGAPKPKANQQKQDDGRGLVLPGYKHLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 119 - protein, 737 aa, Unknown
  vp1, clone rh.69
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTISYTFEDVPFHSSYAHSQSLDRLMNPLIDQYLYYLARTQSNAGGTAGNQELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 120 - protein, 735 aa, Unknown
  vp1, clone rh.60
MAADGYLPDWLEDNLSEGIHEWWDPKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTHNNHLYKQISNGTSGGSTNDNVYFGYSTPWGYFDFNRFHCHFSPRDRQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTEGTAGTQQLLFSQAGPSNMSAQARNWLPGPCYRQQRVSTTLSQNNNSNFAWTGATKYHLNGRDSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 121 - protein, 736 aa, Unknown
  vp1, clone hu.31
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGGQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVSTEGVYSEPRPIGTRYLTRNL

SEQ ID NO: 122 - protein, 736 aa, Unknown
  vp1, clone hu.32
MAADGYLPDWLEDTLSEGIRQWWKLKPGPPPPKPAERHKDDSRGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGSQPAKKKLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 123 - protein, 736 aa, Unknown
  capsid of hu.14/AAV9
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 124 - protein, 735 aa, Unknown
  vp1, clone hu.33
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTGTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 125 - protein, 735 aa, Unknown
  vp1, clone hu.34
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNESQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 126 - protein, 735 aa, Unknown
  vp1, clone hu.36
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAAGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 127 - protein, 735 aa, Unknown
  vp1, clone hu.45
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSGYQLPYVLGSAHQGCLPPFPADVFMVPQYGYPTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAVASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 128 - protein, 735 aa, Unknown
  vp1, clone hu.47
MAADGYLPDWLEDTLSEGIRQWWKLKPGPPPPKPAERHRDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDSHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 129 - protein, 735 aa, Unknown
  vp1, clone hu.13
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 130 - protein, 735 aa, Unknown
  vp1, clone hu.28
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLSLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIQDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVGQDRDVYLQGPTWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 131 - protein, 735 aa, Unknown
  vp1, clone hu.30
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNSFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 132 - protein, 735 aa, Unknown
  vp1, clone hu.29
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLGYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 133 - protein, 735 aa, Unknown
  vp1, clone hu.19
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGEKRPVEHSPAEPDSSSGTGKAGQQPARKRLNFGQTGDADSVPDPQPLGQPPAAPSGLGTNTMASGSGAPMADNNEGADGVGNSSGNWYCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLVGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 134 - protein, 735 aa, Unknown
  vp1, clone hu.20
MAADGYLPDWLEDTLSEGIRQWWKLKPGPPPPKPAERHKDDSRGLVLPGYRYLGPFNGLDKGEPVNEADAAALEHDKAYDRQLDSGDNPYLKYNHVDAEFQERLKEDTSFGGNLGRAVFQAKKRILEPLGLVEEPVKAAPGEKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGHFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPPMGGFGLKHPPPQILIKNTPVPANPSTTFSAAKFASFITQYSTGQVSVEIEWELQKENSKRWNPEIQYTSNYNKSVNVDFTVDTNGVYSEPRPIGARYLTRNL

SEQ ID NO: 135 - protein, 735 aa, Unknown
  vp1, clone hu.21
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPRPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 136 - protein, 735 aa, Unknown; identical to SEQ ID NO: 135
  vp1, clone hu.24

SEQ ID NO: 137 - protein, 735 aa, Unknown
  vp1, clone hu.23-2
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTCNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTYLQSGNTQAATSDVNTQGVLPGMVWQDRDVYLRGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 138 - protein, 735 aa, Unknown
  vp1, clone hu.22
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKGDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGGRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQTLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 139 - protein, 735 aa, Unknown
  vp1, clone hu.26
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTMSRLQFSQAGASDIRDQSRNWLPGPCYRQQRVSKTAADNNNSDYSWTGATKYHLNGRDSLVNPGPAMASHKDDEEKYFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 140 - protein, 735 aa, Unknown
  vp1, clone hu.27
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRILEPLGLVEEPVKTAPGKKRPVEHSPAEPDSSSGTGKAGQQPARKRLNFGQTGDADSVPDPQPLGQPPAAPSGLGTNTMASGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLSFKLFNIQVKEVTQNDGTTTIANNLTSTVQVFTDSGYQLPYVLGSAHQGCLPPFPADVFMVPQYGYLTLNNGSQAVGRSSFYCLEYFPSQMLRTGNNFTFSYTFEDVPFHSSYAHGQSLDRLMNPLIDQYLYYLSRTNTPSGTTTMSRLQFSQAGASDVRDQSRNWLPGPCYRQQRVSKTAADNNNSDYSWTGATKYHLNGRDSLVNPGPAMASHKDDEEKYFPQSGVLVFGKQDSGKTNVDIEKVMITDEEEIRTTNPAATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFVSFITQYSTGQVSVEIEWELQKENSKRWNPEIQYTSNYNKSVNVDFTVDTNGVYSEPRPIGTRYLTRNL

SEQ ID NO: 141 - protein, 735 aa, Unknown
  vp1, clone hu.4
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLVNNNRGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 142 - protein, 735 aa, Unknown
  vp1, clone hu.5
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASRKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 143 - protein, 735 aa, Unknown
  vp1, clone hu.2
MAADGYPPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQRPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNRQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 144 - protein, 735 aa, Unknown
  vp1, clone hu.1
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNGGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANGNNNSNFPWTAATKYHLNGRDSLVNPGPAMASHKDDEEKFFPMHGTLIFGKQGTNANDADLENVMITDEEEIRATNPVATEQYGTVSNNLQNSNTGPTTGTVNHQGALPGMVWQDRDVYLQGPIWAKIPHTDGHFHPSPLTGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 145 - protein, 736 aa, Unknown
  vp1, clone hu.3
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLRPGLRKPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLDDRVIATSTRTWALPTYNNHLYKQISSQSGACNDNHYFGYSTPWGYFDFNRFHCHFSPRDWQRLINSNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFQFSYTFEDVPFHSSYAHCQSLDRLMNPLIDQYLYYLNKTQTNSGTLQQSRLLFSQAGPTNMSLQAKNWLPGPCYRQQRLSKQANDNNNCNFPWTAATKYHLNGRDSLVNPGPAMASHKDDEEKFFPMHGTLIFGKQGTNANDADLENVMITDEEEIRPTNPVATEQYGTVSNNLQNSNTGPTTGTVNHQGALPGMVWQDRDVYLQGPIWAKIPHTDGHFHPSPLMGGFGLKHPPPQIMIKSTPVPANPPTNFSSAKFASSITQYSTGQVSVEIEWELQKENSKRWNPEIQYTSNYNKSVNVDFTVDTNGVYSEPRPIGTRYLTRNL

SEQ ID NO: 146 - protein, 735 aa, Unknown
  vp1, clone hu.25
MAADGYLPDWLEDTLSEGIRQWWKLKPGPPPPKPAERHKDGSRGLVLPGYKYLGPFNGLDKGEPVNEADAAALEHDKAYDRQLNSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSPFYCLEYFPSQMLRTGNNFQFSYTFEDVPFHSSYAHSQSLDRLMNPLIDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDNNGVYSEPRPIGTRYLTRNL

SEQ ID NO: 147 - protein, 735 aa, Unknown
  vp1, clone hu.15
MAADGYLPDWLEDTLSEGIRQWWKLKPGPPPPKPAERHKDDSRGLVLPGYKYLGPFNGLYKGEPVDEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDRQRLINNNWGFRPKRLNFKLFNIQVKEVTQNDGTTTIANNLTSTVQVFTDSGYQLPYVLGLAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKEDSKRWNPEIQYTSNYNKPVNVDFTVDTNGVYSEPRPIGTRYLTRNL

SEQ ID NO: 148 - protein, 735 aa, Unknown
  vp1, clone hu.16
MAADGYLPDWLEDTLSEGIRQWWKLKPGPPPPKPAERHKDDSRGLVLPGYKYLGPFNGLYKGEPVNEADAAALEHDKAYDRQLDSGDNPYLKYNHAGAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGSTTMATGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQDSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 149 - protein, 735 aa, Unknown
  vp1, clone hu.18
MAADGYLPDWLEDTLSEGIRQWWKLKPGPPPPKPAERHKDDSRGLVLPGYKYLGPFNGLDKGEPVNEADAAALEHDKAYDRQLESGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMASGSGAPVADNNEGADGVGNSSGNWHCDSQWLGDRVITTSTRTWALPTYNNHLYKQISSQSGASNDNHYFGYSTPWGYFDFNRFHCHFSPRDWQRLINNSWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLLNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSSKFASFITQYSTGQVSVEIEWELQKENSKRWNPEIQYTSNYNKSVNVDFTVDTNGVYSEPRPIGTRYPTRNL

SEQ ID NO: 150 - protein, 735 aa, Unknown
  vp1, clone hu.7
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEGPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 151 - protein, 735 aa, Unknown
  vp1, clone hu.8
MAADGYLPDWLEDTLSEGTRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 152 - protein, 735 aa, Unknown
  vp1, clone rh.56
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWAQPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGALQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHRGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 153 - protein, 735 aa, Unknown
  vp1, clone hu.11
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYRLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 154 - protein, 735 aa, Unknown
  vp1, clone hu.12
MAADGYLPDWLEDTLSEGIRQWWKLKPGPPPPKPAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRPSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 155 - protein, 735 aa, Unknown
  vp1, clone hu.9
MAADGYLPDWLEDTLSEGIRQWWKLKPGPPPPKPAERHQDNSRGLVLPGYKYLGPSNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGCSTPWGYFDFNRFHCHFSPRDWQRLINNNWGFRPKRLNFKLFNIQVKEVTQNDGTTTIANNLTSTVQVFTDSEYPLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPCPIGTRYLTRNL

SEQ ID NO: 156 - protein, 735 aa, Unknown
  vp1, clone hu.10
MAADGYLPDWLEDTLSEGIRQWWKLKPGPPPPKLAERHQDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGHQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFTVPQYGYLTLNNGSQAVGRSSFYCLEYFPSQMLRTGNNLTFSYTFEDVPFHSSYAHSQSLDRLMNPLIDQYLYYLNRTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLEHVMITDEEEIRTTNPVATEQYGNVSNNLQNSNTGPTTENVNHQGALPGMVWQDRDVYLQGPIWAKIPHTDGHFHPSPLMGGFGLKHPPPQIMIKNTPVPANPPTNYSSAKFASFITQYSTGQVSVEIEWELRKENSKRWNPEIQYTSNYNKSVNVDFTVDTNGVYSEPRPIGTRYLTRNL

SEQ ID NO: 157 - protein, 736 aa, Unknown
  vp1, clone hu.48
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSTSTGASNDNHYFGYGTPWGYFDFNRFHCHFSPRDWQRLINNNWGFRPKRLNFKLFNIQVEEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAVASHKDDEDKFFPMSGVMIFGKESAGASSTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 158 - protein, 736 aa, Unknown
  vp1, clone hu.44
MAADGYLPDWLEDTLSEGIRQWWKLRPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAETAPGKKRPVEQSPQGPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYPNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQGRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 159 - protein, 736 aa, Unknown
  vp1, clone hu.46
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSPSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGRLPPFPADVFMIPQYGYLTLNNGSQAVGRSSSYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSAGQVSVEIEWELQKENSKRWNPEVQYTSNYAKSANVDFTVDNNGLYTEPRPIGTRYLTRPL

SEQ ID NO: 160 - protein, 737 aa, Unknown
  vp1, clone hu.43
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTPFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIVQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

SEQ ID NO: 161 - protein, 738 aa, Unknown
  vp1, clone hu.38
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNCHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 162 - protein, 736 aa, Unknown
  vp1, clone rh.71
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 163 - protein, 736 aa, Unknown
  vp1, clone rh.43
MAADGYLPDWLEDNLSEGIREWWDLKPGAPKPKANQQKQDDGRGLVLPGYKYLGPFNGLDKGEPVNAADAAALEHDKAYDQQLEAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPVTGSCFWQQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 164 - protein, 735 aa, Unknown
  vp1, clone hu.35
MAADGYLPDWLEDTLSEGIRQRWKLKPGPPPPEPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLGRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 165 - DNA, 3161 bp, Unknown
  new AAV serotype, clone hu.136.1
gattgaatttagcggccgcgaattcgcccttgctgcgtcaactggaccaatgagaactttccattcaatgattgcgtcgacaagatggtgatctggtgggaggagggaaagatgaccgccaaggtcatggagtcggccaaagccattctcggaggaagcaaggtgcgcgtggaccagaaatgtaagtcctcggcccagatagacccgactcccgtgattgtcacctccaacaccaacatgtgcgccgtgattgacgggaactcaacgaccttcgagcaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagccaagaaaagacccgcccccagtgacgcagatataagtgagcccaaacgggcgcgcgggtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaggactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaaccctgcaggactagtccctttagtgagg

SEQ ID NO: 166 - DNA, 3162 bp, Unknown
  new AAV serotype, clone hu.140.1
gaattgaatttagcggccgcgaattcgcccttcgcagagaccaaagttcaactgaaacgaattaaacggtttattgattaacaagcaattacagattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaagtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccgtactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagccgctgtggaaaggaacgtcctcaaaagtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtttgtagaggtggttgttgtaggtgggcagggcccaggttcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcctggagccgtcttgacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggctcacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 167 - DNA, 3164 bp, Unknown
  new AAV serotype, clone hu.140.2
gcgaattgaatttagcggccgcgaattcgcccttcgcagagaccaaagttcaactgaaacgaattaaacggtttattgattaacaagcaattacaaattacgagtcaggtatctggtgccaatggggcgaggctctgaatacacgccattagtgtccacagtaaagtccacattaacagacttgttgtagttggaagtgtactgaatttcgggattccagcgtttgctgttttccttctgcagctcccactcgatctccacgctgacctgtcccgtggagtactgtgtgatgaaggaagcaaactttgccgcactgaaggtggtcgaaggattcgcaggtaccggggtgttcttgatgagaatctgtggaggagggtgtttaggtccgaatccacccatgaggggagaggggtgaaaatgtccgtccgtgtgtggaatctttgcccagatgggcccctgaaggtacacatctctgtcctgccagaccatgcctggaagaacgccttgtgtgttgacatctgcggtagctgcttgtctgttgcctctctggaggttggtagatacagaaccatactgctccgtagccacgggattggttgtcctgatttcctcttcgtctgtaatcatgaccttttcaatgtccacatttgttttctctgagccttgcttcccaaagatgagaaccccgctctgaggaaaaaacttttcttcattgtccttgtggcttgccatggccgggcccggattcaccagagagtctctgccattgaggtggtacttggtagctccagtccacgagtattcactgttgttgttatccgcagatgtctttgatactcgctgctggcggtaacagggtccaggaagccagttcctagactggtcccgaatgtcactcgctccggcctgagaaaactgaagccttgactgcgtggtggttccacttggagtgtttgttgtgctcaagtaatacaggtactggtcgatgagaggattcatgagacggtccagactctggctgtgagcgtagctgctgtggaaaggaacgtcctcaaaagtgtagctgaaggtaaagttgtttccggtacgcagcatctgagaaggaaagtactccgggcagtaaaatgaagagcgtcctactgcctgactcccgttgctcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctctttgacttgaatgttaaagagcttgaagttgagtctcttgggtcggaatccccagttgttgttgatgagtctttgccagtcacgtggtgaaaagtggcagtggaatctgttgaagtcaaaatacccccaaggggtgctgtagccaaagtagtgattgtcgttcgaggctcctgattggctggaaatttgtctgtagaggtggttgttgtaggtgggcagggcccaggttcgggtgctggtggtgatgactctgtcgcccatccatgtggaatcgcaatgccgatttcccgaggaattacccactccgtcggcgccctcgttattgtctgccattggtgcgccactgcctgtagccatcgtattagttcccagaccagagggggctgctggtggctgtccgagaggctgggggtcaggtactgagtctgcgtctccagtctgaccaaaattcaatctttttcttgcaggctgctggcccgcctttccggttcccgaggaggagtctggctccacaggagagtgctctaccggcctcttttttcccggagccgtcttaacaggttccccaaccaggcccagaggttcaagaaccctctttttcgcctggaagactgctcgtccgaggttgcccccaaaagacgtatcttctttaaggcgctcctgaaactccgcgtcggcgtggttgtacttgaggtacgggttgtctccgctgtcgagctgccggtcgtaggctttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcaaagatgcagtcatccaaatccacattgaccagatcgcaggcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtctgcgtagttgatcgaagcttccgcgtctgacgtcgatggctgcgcaactgactcgcgcacccgtttgggcccacttatatctgcgtcactgggggcgggtcttttcttggctccaccctttttgacgtagaattcatgctccacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcacggcgcacatgttggtgttggaggtgacgatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacacagtcgttgaagggaaagttctcattggtccagttgacgcagcaagggcgaattcgtttaaacctgcaggactagtccctttagtgaggg

SEQ ID NO: 168 - DNA, 3159 bp, Unknown
  new AAV serotype, clone hu.147.2
gattgatttagcggccgcgaattcgcccttgctgcgtcaactggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtccatagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgagg

SEQ ID NO: 169 - DNA, 3156 bp, Unknown
  new AAV serotype, clone hu.147.3
cgattgaatttagcggccgcgaattcgcccttgctgcgtcaacggaccaatgagaactttcccttcaacgattgcgtcgacaagatggtgatctggtgggaggagggaaagatgaccgccaaggtcgtggagtcggccaaagccattctcggaggaagcaaggtgcgtgtggaccaaaagtgcaagtcttcggcccagatcgacccgactcccgtgatcgtcacctccaacaccaacatgtgcgccgtgattgatggaaactcaacgaccttcgagcaccagcagccgttgcaagaccggatgttcaaatttgaacttacccgccgtctggatcatgactttggaaaggtcaccaagcaggaagtgaaagactttttccggtgggcaaaggatcacgtggttgaggtggagcatgagttctacgtcaaaaagggtggagccaaaaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagcgaatgaatcagaattcaaatatctgcttcactcacggacagaaagactgtttagagtgctttcccgtgtcagaatctcaacccgtttctgtcgtcaaaaaggcgtatcagaaactgtgctacattcatcacatcatgggaaaggtgccagacgcttgcactgcttgcgacctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 170 - DNA, 3158 bp, Unknown
  new AAV serotype, clone hu.161.10
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgcggaccagaaatgcaagtcctcggcccagatagacccgactcccgtgattgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcgggcaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcactctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcaattcagctacacttttgaagacgtgcctttccacagcagctacgctcacagccagagtctggatcggctgatgaatcctctggtcgaccagtacctgtattatctgaacaagacacaaacaaatagtggaactcttcagcagtctcggctactgtttagccaagctggacccaccaacatgtctcttcaagctaaaaactggctgcctggaccttgctacagacagcagcgtctgtcaaagcaggcaaacgacaacaacaacagcaactttccctggactgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactgatgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtga

SEQ ID NO: 171 - DNA, 3167 bp, Unknown
  new AAV serotype, clone hu.172.1
attgaatttagcggccgcgaattcgcccttcgcagagaccaaagttcaactgaaacgaattaaacggtttattgattaacaagcaattacagattacgagtcaggtacctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgatgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccggaatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcttgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctgctggcccgcttttccggttcccgaggaggagtctggctccgcaggagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttggggtacgggttgtctccgctgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagccgtagaaagggcgaattcgtttaaacctgcaggactagtccctttagtgagggt

SEQ ID NO: 172 - DNA, 3161 bp, Unknown
  new AAV serotype, clone hu.172.2
aattgaatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactgaatctcgggattccagcgtttgctgttctccttctgcagctcccactcgatctccacgctgacctgccccgtggagtactgtgtaatgaaggaagcaaactttgccgcactgaaggtagtcgaaggattcgcaggtaccggggtgttcttgatgagaatctgcgggggagggtgtttaagtccgaatccgcccatgaggggagaggggtgaaaatgtccgtccgtgtgtggaatctttgcccagatgggcccctgcaggtacacgtctctgtcctgccacaccatgcctggaagaacgccttgtgtgttgacatctgaggtagctgcttgtgtgttgccgctctggaggttggtagatacagaaccatactgctccgtagccacgggattggtggtcctgatttcctcttcgtctgtaatcatgaccttttcaatgtccacattagtttttcccgagtcttgttttccaaagatgagaaccccgctctgaggaaaaaacttttcttcatcgtccttgtggctggccatggccgggcccggattcaccagagagtctcttccattaaggtggtacttggtagctccagtccacgagtattcactgttgttgttatccgcagatgtctttgatactcgctgctggcggtaacagggtccaggaagccagttcctagactggtcccgaatgtcacttgctccggcctgagaaaactgaagccttgactgcgtggtggttccgcttggagtgtttgttctgctcaagtaatacaggtactggtcgacgagaggattcatgagacggtccaaactctggctgtgggcgtagctgctgtggaaaggaacgtcctcaaaggtgtagctgaaggtaaagttgtttccggtacgcagcatctgagaaggaaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccgtcattctgcgtgacctccttgacttgaatgttaaagagcttgaagttgagtcttttgggccgggatccccaattgttgttgatgagtctttgccagtcacgtggcgaaaagtggcagtggaatctgttgaagtcaaaatacccccaaggggtgctgtagccaaagtagtggttgtcgtttgaggctcctgattggctggaaatctgcctgtagaggtggttgttgtaggtgggcagagcccaggtgcgggtgctggtggtgatgactctgtcgcccatccatgtggaatcgcaatgccaatttcccgaggaattacccactccgtcggcgccctcgttattgtctgccattggtgcgccactgcctgtagccatcgtattagttcccagaccagagggggctgctggtggctgtccgagaggctgggggtcaggtacggagtctgcgtctccagtctgaccgaaattcaatctccttcttgcaggctgctggcccgcttttccggttcccgaggaggagtctggctccgcaagagagtgctctaccggcctcttttttcccggagccgtcttaacaggttcctcaaccaggcccagaggttcaagaaccctctttttcgcctggaagactgctcgtccgaggttgcccccaaaagacgtatcttctttaagacgctcctggaactccgcgtcggcgtggttgtacttgaggtacgggttgtctccgccgtcgagctgccggtcgtaggccttgtcgtgctcgagggccgcggcgtctgcctcgttgaccggctctcccttgtcgagtccgttgaagggtccaaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaagcagtgcaagcgtctggcacctttcccatgatatgatgaatgtagcacagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgattgaagcttccgcgtctgacgtcgatggctgcgcaactgactcgcgcgcccgtttgggctcacttatatctgcgtcactgggggcgggtctttttttggctccaccctttttgacgtagaattcatgctctacctcaaccacgtgatcctttgcccaccggaaaaagtctttgacttcctgcttggtgaccttcccaaagtcatgatccagacggcgggtgagttcaaatttgaacatccggtcttgcaacggctgctggtgttcgaaggtcgttgagttcccgtcaatcactgcgcacatgttggtgttggaggtgacaatcacgggagtcgggtctatctgggccgaggacttgcatttctggtccacgcgcaccttgcttcctccgagaatggctttggccgactccacgaccttggcggtcatcttcccctcctcccaccagatcaccatcttgtcgacgcaatcattgaaaggaaagttctcattggtccagttgacgcagcaagggcgaattcgtttaaacctgcaggactagtccctttagtgaggg

SEQ ID NO: 173 - DNA, 3172 bp, Unknown
  new AAV serotype, clone hu.173.4
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcgacgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcttccccggcgcgtcggaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccgcgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccgagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcagctgcgcacacagccagagctcggaccgactgatgaatcctctcatcgaccagtacctgtactacttatccagaactcggtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacaacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 174 - DNA, 3159 bp, Unknown
  new AAV serotype, clone hu.161.8
gattgaatttagcggccgcgaattcgcccttgctgcgtcaactggaccaatgagaactttcctttcaatgattgcgtcgacaagatggtgatctggtgggaggagggaaagatgaccgccaaggtcgtggagtcggccaaagccattctcggaggaagcaaggtgcgcgtggaccagaaatgcaagtcctcggcccagatagacccgactcccgtgattgtcacctccaacaccgacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatgaattctacgtcaaaaagggtggagctaagaaaagacccgcccccagtgacgcagatataagtgagcccaaacgggcgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcagaattcaaatatctgcttcactcacggacagaaagactgtttagagtgctttcccgtgtcagaatctcaacccgtttctgtcgtcaaaaaggcgtatcagaaactttgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggggagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcaaaaaagagggttcttgaacctctgggcctggttgaggaacctgttaaaacggctccgggaaaaaagaggccggtagagcaccctcctgtggagccagactcctcctcgggaaccggaaaagcgggccagcagcctgcaagaaaaagattgaatttcggtcagactggagacgcagactccgtacctgacccccagcctctcggacagccaccagcagccccctctggtctgggatctactacaatggctacaggcagtggcgcaccaatggcagacaataacgagggtgccgatggagtgggtaattcctcgggaaattggcattgcgattcccaatggctgggcgacagagtcatcaccaccagcacccgcacctgggccctgcccacctacaacaaccacctctacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcagtaggacgctcttcattttactgcctggagtactttccttctcagatgctgcgtaccggaaacaactttcagttcagctacacttttgaagacgtgcctttccacagcagctacgctcacagccagagtctggatcggctgatgaatcctctgatcgaccagtacctgtattatctgaacaagacacaaacaaatagtggaactcttcagcagtctcggctactgtttagccaagctggacccaccaacatgtctcttcaagctaaaaaccggctgcctggaccttgctacagacagcagcgtctgtcaaagcaggcaaacgacaacaacaacagcaactttccctggaccgcagctacaaagtatcatctaaatggccgggactcgttggttaatccaggaccagctatggccagtcacaaggatgacgaagaaaagtttttccccatgcatggaacccttatatttggtaaacaaggaacaaatgccaacgacgcggatttggaaaatgtcatgattacagatgaagaagaaatcaggaccaccaatcccgtggctacggagcagtacggaactgtatcaaataatttgcaaaactcaaacactggtccaactactggaactgtcaatcaccaaggagcgttacctggtatggtgtggcaggatcgagacgtgtacctgcagggacccatttgggccaagattcctcacaccgatggacactttcatccttctccactggtgggaggttttggactcaaacacccacctcctcaaatcatgatcaaaaacactcccgttccagccaatcctcccacaaacttcagttctgccaagtttgcttctttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgtttaaacctgcaggactagtccctttagtgag

SEQ ID NO: 175 - DNA, 3172 bp, Unknown
  new AAV serotype, clone hu.173.8
gattgaatttagcggccgcgaattcgcccttgctgcgtcaactggaccaatgagaactttcccttcaacgattgcgtcgacaagatggtgatctggtgggaggagggcaagatgaccgccaaggtcgtggagtccgccaaggccattctgggtggaagcaaggtgcgcgtggaccaaaagtgcaagtcatcggcccagatcgaccccacgcccgtgatcgtcacctccaacaccaacatgtgcgccgtgatcggcgggaacagcaccaccttcgagcaccagcagcccctgcaggaccgcatgttcaagttcgagctcacccgccgtctggagcacgactttggcaaggtgaccaagcaggaagtcaaagagttcttccgctgggctcaggatcacgtgactgaggtggcgcatgagttctacgtcagaaagggcggagccaccaaaagacccgcccccagtgacgcggatataagcgagcccaagcgggcctgcccctcagttgcggagccatcgacgtcagacgcggaagcaccggtggactttgcggacaggtaccaaaacaaatgttctcgtcacgcgggcatgcttcagatgctgtttccctgcaagacatgcgagagaatgaatcagaatttcaacgtctgcttcacgcacggggtcagagactgctcagagtgcctccccggcgcgtcagaatctcaacccgtcgtcagaaaaaagacgtatcagaaactgtgcgcgattcatcatctgctggggcgggcacccgagattgcgtgttcggcctgcgatctcgtcaacgtggacttggatgactgtgtttctgagcaataaatgacttaaaccaggtatggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaattgctggttaatcaataaaccgtttgattcgtttcagttgaactttggtctctgcgaagggcgaattcgtttaaacctgcaggactagtccctttagtgagg

SEQ ID NO: 176 - DNA, 3160 bp, Unknown
  new AAV serotype, clone hu.145.1
acccttcactaaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcgggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcagacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtactacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaatcaatcg

SEQ ID NO: 177 - DNA, 3157 bp, Unknown
  new AAV serotype, clone hu.145.5
ctcactaagggactagtcctgcaggtttaaacgaattcgcccttgctgcgtcaactggaccaatgagaactttcccttcaacgactgtgtcgacaagatggtgatttggtgggaggaggggaagatgaccgccaaggtcgtggagtcggccaaagccactctcggaggaagcaaggtgcgcgtggaccagaaacgcaagtcctcggcccagatagatccgactcccgtgatcgtcacctccaacaccaacatgtgcgccgtgattgacgggaactcaacgaccttcgaacaccagcagccgttgcaagaccgaatgttcaaatttgaactcacccgccgtctggatcatgacttcgggaaggtcaccaagcaggaagtcaaagactttttccggtgggcaaaggatcacgtggttgaggtggagcatgaattctacgtcaaaaagggtggagccaagaaaagacccgcccctagtgacgcagatataagtgagcccaaacgggtgcgcgagtcagttgcgcagccatcgacgtcagacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgtgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggctctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccgcttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtactttccttctcagatgctgcgtactggaaacaactttcagttcagctacacttttgaagacgtgcctttccacagcagctacgctcacagccagggtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcggagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcggggacccatttgggccaagattcctcacgccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcg

SEQ ID NO: 178 - DNA, 3163 bp, Unknown
  new AAV serotype, clone hu.145.6
accctcactaaagggactagtcctgcaggtttaaacgaattcgcccttgctgcgtcaactggagcaatgagaactttcccttcaacgactgtgtcgacaagatggtgatttggtgggaggaggggaagatgaccgccaaggtcgtggagtcggccaaagccattctcggaggaagcaaggtgcgcgtggaccagaaatgcaagtcctcggcccagatagatccgactcccgtgatcgtcacctccaacaccaacatgtgcgccgtgattgacgggaactcaacgaccttcgaacaccagcagccgttgcaagaccggatgttcaaatttgaactcacccgccgtctggatcatgactttgggaaggtcaccaagcaggaagtcaaagactttttccggtgggcaaaggatcacgtggttgaggtggagcatggattctacgtcaaaaagggtggagccaagaaaagacccgcccctagtgacgcagatataagtgagcccaaacgggtgcgcgagtcagttgcgcagccatcgacgtcggacgcggaagcttcgatcaactacgcggacaggtaccaaaacaaatgttctcgtcacgtgggcatgaatctgatgctgtttccctgcagacaatgcgagagaatgaatcaaaattcaaatatctgcttcactcacggacagaaagactgtttagagtgctttcccgtgtcagaatctcaacctgtttctgtcgtcaaaaaggcgtatcagaaactgcgctacattcatcatatcatgggaaaggtgccagacgcttgcactgcctgcgatctggtcaatgtggatttggatgactgcatctctgaacaataaatgatttaaatcaggtatggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaaaagactgaatttcggtcagactggagacgcagactccgtacctgacccccagcctctcggacagccaccagcagcccccacaagtttgggatctactacaatggctacaggcagtggcgcaccaatggcagacaataacgagggtgccgatggagtgggtaattcctcaggaaattggcattgcgattcccaatggctgggcgacagagtcatcaccaccagcacccgaacctgggccctgcccacctacaacaaccacctttacaagcaaatctccagccaatcaggagcctcaaacgacaaccactactttggctacagcaccccctgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgtttccagcggacgtcttcatggtcccacagtatggatacctcaccctgaacaacgggagtcaggcggtaggacgctcttccttttactgcctggagtgctttccttctcagatgctgcgtactggaaacaactttcagttcagctacacttttgaagacgtgcctttccacagcagctacgctcacagccagagtttggatcggctgatgaatcctctgatcgaccagtacctgtattatctaaacagaacacaaacagctagtggaactcagcagtctcggctactgtttagccaagctggacccacaagcatgtctcttcaagctaaaaactggctgcctggaccgtgttatcgccagcagcgtttgtcaaagcaggcaaacgacaacaacaacagcaactttccctggactggagctaccaagtaccacctcaatggcagagactctttggtgaacccgggcccggccatggccagccacaaggacgatgaagaaaagtttttccccatgcatggaaccctaatatttggtaaagaaggaacaaatgctaccaacgcggaattggaaaatgtcatgattacagatgaagaggaaatcaggaccaccaatcccgtggctacagagcagtacggatatgtgtcaaataatttgcaaaactcaaatactgctgcaagtactgaaactgtgaatcaccaaggagcattacctggtatggtgtggcaggatcgagacgtgtacctgcagggacccatttgggccaagattcctcacaccgatggacactttcatccttctccactgatgggaggttttggactcaaacacccgcctcctcagattatgatcaaaaacactcccgttccagccaatcctcccacaaacttcagttctgccaagtttgcttccttcatcacacagtattccacgggacaggtcagcgtggagatcgagtgggagctgcagaaggagaacagcaaacgctggaatcccgaaattcagtacacttccaactacaacaaatctgttaatgtggactttactgtggacactaatggtgtgtattcagagcctcgccccattggcaccagatacctgactcgtaatctgtaattgcttgttaatcaataaaccgtttaattcgtttcagttgaactttggtctctgcgaagggcgaattcgcggccgctaaattcaattcgcc

SEQ ID NO: 179 - DNA, 3161 bp, Unknown
  new AAV serotype, clone hu.156.1
cgaattgatttagcggccgcgaattcgcccttcgcagagaccaaagttcaactgaaacgaattaaacggtttattgattaacaagcaattacagattacgagtcaggtatctggtgccaatggggcgaggctctgaatacacaccattagtgtccacagtaaagtccacattaacagatttgttgtagttggaagtgtactggatctcgggattccagcgtttgctgttctccttctgtagctcccactcgatctccacgctgacccgccccgtggaatactgtgtgatgaaggaagcaaactttgccgcactgaaggtggtcgaaggattcgcaggtaccggggtgtttttgatgagaatctgtggaggagggtgtttaagtccgaatccgcccatgaggggagaggggtgaaaatgtccgtccgtgtgcggaatctttgcccagataggcccctgcaggtacacgtctctgtcctgccagaccatgcctggaagaacgccttgtgtgttgacatctgcagtagatgcttgtgtgttgccgctctggaggttggtagatacagaaccatactgctccgtggccacgggattggtggttctgatttcctcttcgtctgtaatcatgaccttttcaatgtccacatttgttttctctgatccttgttttccaaagatgagaaccccgctctgaggaaaaaacttttcttcatcgtccttgtggctggccattgccgggcccggattcaccagagagtctctgccattgaggtggtacttggtagctccaatccacgagtattcactgttgttgttgtccgcagatgtctttgatactcgctgctggcggtaacagggtccaggaagccagttcctagactgatcccgaatgtcactcgctccggcctgagaaaactgaagcctggactgcgtggtggttccgcttggagtgtttgttctgctcaagtaatacaggtactggtcgatgagaggattcatgagacggtccaaactctggctgtgagcgtagctgctgtggaaaggaacatcctcaaaggtgtagctgaaggtaaagttgtttccggtacgcagcatctgagaagggaagtactccaggcagtaaaatgaagagcgtcctactgcctgactcccgttgttcagggtgaggtatccatactgtggcaccatgaagacgtctgctgggaacggcgggaggcatccttgatgcgccgagccgaggacgtacgggagctggtactccgagtcagtaaacacctgaaccgtgctggtaaggttattggcaatcgtcgtcgtaccatcattctgcgtgacctctctgacttgaatgttaaagagcttgaagttgagtctcttgggccggaatccccagttgttgttgatgagtctttgccagtcacgtggtgaaaagtggcagtggaatctgttgaagtcaaaatacccccaaggggtgctgtagccaaagtagtggttgtcgttgctggctcctgattggctggaaatctgcttgtacagatggttgttgtaggtgggcagagcccaggttcgggtgctggtggtgatgactctgtcgcccatccatgtggaatcgcaatgccaatttcccgaggaattacccactccgtcggcgccatcgttattgtctgccattggtgcgccactgcctgtagccatcgtattagttcccagaccagagggggctgctggtggctgtccgagaggctgggggtcaggtacggagtctgcgtctccagtctgaccgaaattcaatctctttcttgcaggctggttgcccgcttttccggttcccgaggaggagtctggctccacaggagagtgctctaccggcctcttttttcccggagccgtcttaacaggctcctcaaccaggcccagaggttcaagaaccctcttttttgcctggaagactgctcgtccgaggttgcccccaaaagacgtatcttctttaaggcgctcctgaaactccgcgtcggcgtggtcgtacttgaggtacgggttgtctccgctgtcgagctgccggtcgtaggccttgtcgtgctcgagggccgcggcgtctgcctcgttgaccggctctcccttgtcgagtccgttgaagggtccgaggtacttgtacccaggaagcacaagacccctgctgtcgtccttatgccgctctgcgggctttggtggtggtgggccaggtttgagcttccaccactgtcttattccttcagagagagtgtcctcgagccaatctggaagataaccatcggcagccatacctgatttaaatcatttattgttcagagatgcagtcatccaaatccacattgaccagatcgcaggcagtgcaagcgtctggcacctttcccatgatatgatgaatgtagcaaagtttctgatacgcctttttgacgacagaaacgggttgagattctgacacgggaaagcactctaaacagtctttctgtccgtgagtgaagcagatatttgaattctgattcattctctcgcattgtctgcagggaaacagcatcagattcatgcccacgtgacgagaacatttgttttggtacctgtccgcgtagttgatcgaagcttccgcgtctgacgtcgatggctgcgcaactgactcgcgcgcccgtttgggctcacttatatctgcgtcactgggggcgggtcttttcttggctccaccctttttgacgtagaattcatgctccacctcaaccacgtgatcctttgcccaccggaaaaagtctttcacttcctgcttggtgaccttcccaaagtcatgatccagacggcgggttagttcaaatttgaacatccggtcttgcaacggctgctggtgttcgaaggtcgttgagttcccgtcaatcacggcgcacatgttggtgttggaggtggcgatcacgggagtcgggtctatctgggccgaggacttgcacttttggtccacgcgcaccttgcttcctccgagaatggcttcggccgattccacgaccttggcggtcatctttccctcctcccaccagatcaccatcttgtcgacacagtcgttgaagggaaagttctcattggtccagttgacgcagcaagggcgaattcgtttaaacctgcaggaactagtcccttagtgagg

SEQ ID NO: 180 - DNA, 4721 bp, Unknown
  adeno-associated virus serotype 7
ttggccactccctctatgcgcgctcgctcgctcggtggggcctgcggaccaaaggtccgcagacggcagagctctgctctgccggccccaccgagcgagcgagcgcgcatagagggagtggccaactccatcactaggggtaccgcgaagcgcctcccacgctgccgcgtcagcgctgacgtaaatcacgtcataggggagtggtcctgtattagctgtcacgtgagtgcttttgcgacattttgcgacaccacgtggccatttgaggtatatatggccgagtgagcgagcaggatctccattttgaccgcgaaatttgaacgagcagcagccatgccgggtttctacgagatcgtgatcaaggtgccgagcgacctggacgagcacctgccgggcatttctgactcgtttgtgaactgggtggccgagaaggaatgggagctgcccccggattctgacatggatctgaatctgatcgagcaggcacccctgaccgtggccgagaagctgcagcgcgacttcctggtccaatggcgccgcgtgagtaaggccccggaggccctgttctttgttcagttcgagaagggcgagagctacttccaccttcacgttctggtggagaccacgggggtcaagtccatggtgctaggccgcttcctgagtcagattcgggagaagctggtccagaccatctaccgcggggtcgagcccacgctgcccaactggttcgcggtgaccaagacgcgtaatggcgccggcggggggaacaaggtggtggacgagtgctacatccccaactacctcctgcccaagacccagcccgagctgcagtgggcgtggactaacatggaggagtatataagcgcgtgtttgaacctggccgaacgcaaacggctcgtggcgcagcacctgacccacgtcagccagacgcaggagcagaacaaggagaatctgaaccccaattctgacgcgcccgtgatcaggtcaaaaacctccgcgcgctacatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattaaaaccaaccgcatctaccgcatcctggagctgaacgggtacgatcctgcctacgccggctccgtctttctcggctgggcccagaaaaagttcgggaagcgcaacaccatctggctgtttgggcccgccaccaccggcaagaccaacattgcggaagccatcgcccacgccgtgcccttctacggctgcgtcaactggaccaatgagaactttcccttcaacgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagccgttgcaggaccggatgttcaaatttgaactcacccgccgtctggagcacgactttggcaaggtgacgaagcaggaagtcaaagagttcttccgctgggccagtgatcacgtgaccgaggtggcgcatgagttctacgtcagaaagggcggagccagcaaaagacccgcccccgatgacgcggatataagcgagcccaagcgggcctgcccctcagtcgcggatccatcgacgtcagacgcggaaggagctccggtggactttgccgacaggtaccaaaacaaatgttctcgtcacgcgggcatgattcagatgctgtttccctgcaaaacgtgcgagagaatgaatcagaatttcaacatttgcttcacacacggggtcagagactgtttagagtgtttccccggcgtgtcagaatctcaaccggtcgtcagaaaaaagacgtatcggaaactctgcgcgattcatcatctgctggggcgggcgcccgagattgcttgctcggcctgcgacctggtcaacgtggacctggacgactgcgtttctgagcaataaatgacttaaaccaggtatggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaattgcatgttaatcaataaaccggttgattcgtttcagttgaactttggtctcctgtgcttcttatcttatcggtttccatagcaactggttacacattaactgcttgggtgcgcttcacgataagaacactgacgtcaccgcggtacccctagtgatggagttggccactccctctatgcgcgctcgctcgctcggtggggcctgcggaccaaaggtccgcagacggcagagctctgctctgccggccccaccgagcgagcgagcgcgcatagagggagtggccaa

SEQ ID NO: 181 - protein, 737 aa, Unknown
  capsid protein of adeno-associated virus serotype 7
MAADGYLPDWLEDNLSEGIREWWDLKPGAPKPKANQQKQDNGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPAKKRPVEPSPQRSPDSSTGIGKKGQQPARKRLNFGQTGDSESVPDPQPLGEPPAAPSSVGSGTVAAGGGAPMADNNEGADGVGNASGNWHCDSTWLGDRVITTSTRTWALPTYNNHLYKQISSETAGSTNDNTYFGYSTPWGYFDFNRFHCHFSPRDWQRLINNNWGFRPKKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSNPGGTAGNRELQFYQGGPSTMAEQAKNWLPGPCFRQQRVSKTLDQNNNSNFAWTGATKYHLNGRNSLVNPGVAMATHKDDEDRFFPSSGVLIFGKTGATNKTTLENVLMTNEEEIRPTNPVATEEYGIVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFEKQTGVDFAVDSQGVYSEPRPIGTRYLTRNL

SEQ ID NO: 182 - DNA, 4393 bp, Unknown
  adeno-associated virus serotype 8
cagagagggagtggccaactccatcactaggggtagcgcgaagcgcctcccacgctgccgcgtcagcgctgacgtaaattacgtcataggggagtggtcctgtattagctgtcacgtgagtgcttttgcggcattttgcgacaccacgtggccatttgaggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgaactgggtggccgagaaggaatgggagctgcccccggattctgacatggatcggaatctgatcgagcaggcacccctgaccgtggccgagaagctgcagcgcgacttcctggtccaatggcgccgcgtgagtaaggccccggaggccctcttctttgttcagttcgagaagggcgagagctactttcacctgcacgttctggtcgagaccacgggggtcaagtccatggtgctaggccgcttcctgagtcagattcgggaaaagcttggtccagaccatctacccgcggggtcgagccccaccttgcccaactggttcgcggtgaccaaagacgcggtaatggcgccggcgggggggaacaaggtggtggacgagtgctacatccccaactacctcctgcccaagactcagcccgagctgcagtgggcgtggactaacatggaggagtatataagcgcgtgcttgaacctggccgagcgcaaacggctcgtggcgcagcacctgacccacgtcagccagacgcaggagcagaacaaggagaatctgaaccccaattctgacgcgcccgtgatcaggtcaaaaacctccgcgcgctatatggagctggtcgggtggctggtggaccggggcatcacctccgagaagcagtggatccaggaggaccaggcctcgtacatctccttcaacgccgcctccaactcgcggtcccagatcaaggccgcgctggacaatgccggcaagatcatggcgctgaccaaatccgcgcccgactacctggtggggccctcgctgcccgcggacattacccagaaccgcatctaccgcatcctcgctctcaacggctacgaccctgcctacgccggctccgtctttctcggctgggctcagaaaaagttcgggaaacgcaacaccatctggctgtttggacccgccaccaccggcaagaccaacattgcggaagccatcgcccacgccgtgcccttctacggctgcgtcaactggaccaatgagaactttcccttcaatgattgcgtcgacaagatggtgatctggtgggaggagggcaagatgacggccaaggtcgtggagtccgccaaggccattctcggcggcagcaaggtgcgcgtggaccaaaagtgcaagtcgtccgcccagatcgaccccacccccgtgatcgtcacctccaacaccaacatgtgcgccgtgattgacgggaacagcaccaccttcgagcaccagcagcctctccaggaccggatgtttaagttcgaactcacccgccgtctggagcacgactttggcaaggtgacaaagcaggaagtcaaagagttcttccgctgggccagtgatcacgtgaccgaggtggcgcatgagttttacgtcagaaagggcggagccagcaaaagacccgcccccgatgacgcggataaaagcgagcccaagcgggcctgcccctcagtcgcggatccatcgacgtcagacgcggaaggagctccggtggactttgccgacaggtaccaaaacaaatgttctcgtcacgcgggcatgcttcagatgctgtttccctgcaaaacgtgcgagagaatgaatcagaatttcaacatttgcttcacacacggggtcagagactgctcagagtgtttccccggcgtgtcagaatctcaaccggtcgtcagaaagaggacgtatcggaaactctgtgcgattcatcatctgctggggcgggctcccgagattgcttgctcggcctgcgatctggtcaacgtggacctggatgactgtgtttctgagcaataaatgacttaaaccaggtatggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaattgcctgttaatcaataaaccggttgattcgtttcagttgaactttggtctctgcg

SEQ ID NO: 183 - protein, 738 aa, Unknown
  capsid protein of adeno-associated virus serotype 7
MAADGYLPDWLEDNLSEGIREWWALKPGAPKPKANQQKQDDGRGLVLPGYKYLGPFNGLDKGEPVNAADAAALEHDKAYDQQLQAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPLGEPPAAPSGVGPNTMAAGGGAPMADNNEGADGVGSSSGNWHCDSTWLGDRVITTSTRTWALPTYNNHLYKQISNGTSGGATNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFQFTYTFEDVPFHSSYAHSQSLDRLMNPLIDQYLYYLSRTQTTGGTANTQTLGFSQGGPNTMANQAKNWLPGPCYRQQRVSTTTGQNNNSNFAWTAGTKYHLNGRNSLANPGIAMATHKDDEERFFPSNGILIFGKQNAARDNADYSDVMLTSEEEIKTTNPVATEEYGIVADNLQQQNTAPQIGTVNSQGALPGMVWQNRDVYLQGPIWAKIPHTDGNFHPSPLMGGFGLKHPPPQILIKNTPVPADPPTTFNQSKLNSFITQYSTGQVSVEIEWELQKENSKRWNPEIQYTSNYYKSTSVDFAVNTEGVYSEPRPIGTRYLTRNL

SEQ ID NO: 184 - protein, 735 aa, Unknown
  vp1, clone hu.60
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLVDQYLYYLNKTQTNSGTLQQSRLLFSQAGPTNMSLQAKNWLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 185 - protein, 735 aa, Unknown
  vp1, clone hu.61
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHPPVEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQTNSGTLQQSRLLFSQAGPTNMSLQAKNRLPGPCYRQQRLSKQANDNNNSNFPWTAATKYHLNGRDSLVNPGPAMASHKDDEEKFFPMHGTLIFGKQGTNANDADLENVMITDEEEIRTTNPVATEQYGTVSNNLQNSNTGPTTGTVNHQGALPGMVWQDRDVYLQGPIWAKIPHTDGHFHPSPLVGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 186 - protein, 734 aa, Unknown
  vp1, clone hu.53
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLRQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYYLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 187 - protein, 734 aa, Unknown
  vp1, clone hu.55
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLECFPSQMLRTGNNFQFSYTFEDVPFHSSYAHSQSLDRLMNPLIDQYLYYLNRTQTASGTQQSRLLFSQAGPTSMSLQAKNWLPGPCYRQQRLSKQANDNNNSNFPWTGATKYHLNGRDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 188 - protein, 734 aa, Unknown
  vp1, clone hu.54
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPTSLGSTTMATGSGAPMADNNEGADGVGNSSGNWHCDSQWLGDRVITTSTRTWALPTYNNHLYKQISSQSGASNDNHYFGYSTPWGYFDFNRFHCRFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQGLDRLMNPLIDQYLYYLNRTQTASGTQQSRLLFSQAGPTSMSLQAKNWLPGPCYRQQRLSKQANDNNNSNFPWTGATKYHLNGGDSLVNPGPAMASHKDDEEKFFPMHGTLIFGKEGTNATNAELENVMITDEEEIRTTNPVATEQYGYVSNNLQNSNTAASTETVNHQGALPGMVWQDRDVYLRGPIWAKIPHADGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 189 - protein, 735 aa, Unknown
  vp1, clone hu.49
MAADGYLPDWLKDTLSEGIRQWWKLKPGPPPPKPAERHKDDSGGLVLPGYKYLGPFNGLDKGEPVNEADAAALEYDKAYDRQLDSGDNPYLKYNHADAEFQERLKEDTSFGGNLGRAVFQAKKRVLEPLGLVEEPVKTAPGKKRPVEHSPVEPDSSSGTGKAGQQPARKRLNFGQTGDADSVPDPQPLGQPPAAPSGLGTNTMATGSGAPMADNNEGADGVGNSSGSWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVPGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATADVNTQGVLPGMVWQDRDVHLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 190 - protein, 735 aa, Unknown
  vp1, clone hu.51
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSGYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 191 - protein, 735 aa, Unknown
  vp1, clone hu.52
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVGEPVKTAPGKKRPVEHSPVEPDSSSGTGKAGQQPARKRLNFGQTGDADSVPDPQPLGQPPAAPSGLGTNTMATGSGAPMADNNEGADGVGNSSGNRHCDSTWMGDRVITTSTRTWALPTYNNHLYRQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLSNGSQAVGRSSFYCPEYFPSQMLRTGNNFTFSYTFEDVPFHSSYAHSQSLDRLMNPLIDQYLYYLSTTNTPSGTTTQSRLQFSQAGASDIRDQSRNWLPGPCYRQQRVSKTSADNNNSEYSWTGATKYHLNGRDSLVNPGPAMASHKDNEEKFFPQSGVLIFGKQGSEKTNVDIEKVMITDEEEIRTTNPVATEQYGSVSTNLQRGNRQAATADVNTQGVLPGMVWQDRDVYLQGPIWAKIPHTDGHFHPSPLMGGFGPKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 192 - protein, 735 aa, Unknown
  vp1, clone hu.56
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPASPSGLGTNTMATGSGAPMADNNEGADGVGNSSGNWHCDSTWMGDRVVTTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSEYSWTGATKYHLNGRDSLVNPGPAMASHKDDEEKFFPQSGVLIFGKQGSEKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 193 - protein, 734 aa, Unknown
  vp1, clone hu.57
MAADGYLPDWLEDTLSEGIRQWWKLKPGPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNEGADGVGNSSGDWHCDSTWMGDRVITTSTRTWALPTYNNHLYKQISSQSGASNDNHYFGYSTPWGYFDFNRFHCHFSPRDWQRLINNNWGFRPKRLNLKLFNIQVKEVTQNDGTTTIANNLTSTVQVFTDLEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNGEYSWTGATKYHLNGRDSLVNPGPAMASHKDDEEKFFPQSGVLIFGKQGSEKTNVDIEKVMITDEEEIRTTNPVATEQYGSVSTNLQSGNTRAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 194 - protein, 735 aa, Unknown
  vp1, clone hu.58
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYDHADAEFQERLKEDTSFGGNLGRAVFQAKKRVLEPLGLVEEPVKTAPGKKRPVEHSPVEPDSSSGTGKAGNQPARKRLNFGQTGDADSVPDPQPLGQPPAAPSGLGTNTMATGSGAPMADNNDGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVREVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWIGATKYHLNGRDSLVNPGPAMASHKDDEEKFFPQSGVLIFGKQGSEKTNVDIEKVMITDEEEIRTTNPVATEQYGSVSTNLQSGNTQASTADVNTQGVLPGMVWQDRDVYLQGPIWAKIPHTDGHFHPSPLMGGFGLKHPPPQILIKNTPVPANPSTTFSAAKFASFITQYSTGRVSVEIEWELQKENSKRWNPEIQYTSNYNKSVNVDFTVDTNGVYSEPRPIGTRYLTRNL

SEQ ID NO: 195 - protein, 735 aa, Unknown
  vp1, clone hu.63
MAADGYLPDWLEDTLSEGIRQWWKLKPGPPPPKPAERHKDDSRGLVLPGYKYLGPFNGLDKGEPVNEADAAALEHDKAYDRQLDSGDNPYPKYNHADAEFQERLKEDTSFGGNLGRAVFQAKKRVLEPLGLVEEPVKTAPGKKRPVEHSPAEPDSSSGTGKAGQQPARKRLNFGQTGDADSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 196 - protein, 735 aa, Unknown
  vp1, clone hu.64
MAADGYLPDWLEDTLSEGIRQWWKLKPGPPPPKPAERHKDDSRGLVLPGYKYLGPFNGLDKGEPVNEADAAALEHDKAYDRQLDGGDNPYLKYNHADAEFQERLKEDTSFGGNLGRAVFQAKKRVLEPLGLVEEPVKTAPGKKRPVEHSLAEPDSSSGTGKAGQQPARRRLNFGQTGDADSVPDPQPLGQPPAAPSGLGTNTMATGSGAPMADNNEGADGVGNSSGNWHCDSTWMGDRVITTSTRTWALPTYNNHLYRQISSQSGASNDNHYFGYSTPWGYFDFNRFHCHFSPRDWQRLINNNWGSRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLVDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGKTNVDIEKVMITDEEEIRTTNPVATEQYGSVSTNLQSGNTQAATSDVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 197 - protein, 738 aa, Unknown
  vp1, clone hu.66
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSAGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTETIANNLTSTIQVFTDSEYQLPYVLGSAHQGCLPPFPADVFMIPQYGYLTLNNGSQAVGRSSFYCLEYFPSQMLRTGNNFEFSYTFEDVPFHSSCAHSQSSDRLMNPLIDQYLYYLSRTRSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 198 - protein, 738 aa, Unknown
  vp1, clone hu.67
MAADGYLPDWLEDNLSEGIREWWDLKPGAPKPKANQQKQDDGRGLVLLGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYTFEDVPFHSGYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGRDNVDYSSVMLTSEEEIKTTNPVATEQYGVVADNLQQTNTGPIVGNVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 199 - DNA, 2175 bp, Unknown
  adeno-associated virus serotype 5
atgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctgttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaa

SEQ ID NO: 200 - DNA, 2211 bp, Unknown
  adeno-associated virus serotype 3-3
atggctgctgacggttatcttccagattggctcgaggacaacctttctgaaggcattcgtgagtggtgggctctgaaacctggagtccctcaacccaaagcgaaccaacaacaccaggacaaccgtcggggtcttgtgcttccgggttacaaatacctcggacccggtaacggactcgacaaaggagagccggtcaacgaggcggacgcggcagccctcgaacacgacaaagcttacgaccagcagctcaaggccggtgacaacccgtacctcaagtacaaccacgccgacgccgagtttcaggagcgtcttcaagaagatacgtcttttgggggcaaccttggcagagcagtcttccaggccaaaaagaggatccttgagcctcttggtctggttgaggaagcagctaaaacggctcctggaaagaagggggctgtagatcagtctcctcaggaaccggactcatcatctggtgttggcaaatcgggcaaacagcctgccagaaaaagactaaatttcggtcagactggagactcagagtcagtcccagaccctcaacctctcggagaaccaccagcagcccccacaagtttgggatctaatacaatggcttcaggcggtggcgcaccaatggcagacaataacgagggtgccgatggagtgggtaattcctcaggaaattggcattgcgattcccaatggctgggcgacagagtcatcaccaccagcaccagaacctgggccctgcccacttacaacaaccatctctacaagcaaatctccagccaatcaggagcttcaaacgacaaccactactttggctacagcaccccttgggggtattttgactttaacagattccactgccacttctcaccacgtgactggcagcgactcattaacaacaactggggattccggcccaagaaactcagcttcaagctcttcaacatccaagttagaggggtcacgcagaacgatggcacgacgactattgccaataaccttaccagcacggttcaagtgtttacggactcggagtatcagctcccgtacgtgctcgggtcggcgcaccaaggctgtctcccgccgtttccagcggacgtcttcatggtccctcagtatggatacctcaccctgaacaacggaagtcaagcggtgggacgctcatccttttactgcctggagtacttcccttcgcagatgctaaggactggaaataacttccaattcagctataccttcgaggatgtaccttttcacagcagctacgctcacagccagagtttggatcgcttgatgaatcctcttattgatcagtatctgtactacctgaacagaacgcaaggaacaacctctggaacaaccaaccaatcacggctgctttttagccaggctgggcctcagtctatgtctttgcaggccagaaattggctacctgggccctgctaccggcaacagagactttcaaagactgctaacgacaacaacaacagtaactttccttggacagcggccagcaaatatcatctcaatggccgcgactcgctggtgaatccaggaccagctatggccagtcacaaggacgatgaagaaaaatttttccctatgcacggcaatctaatatttggcaaagaagggacaacggcaagtaacgcagaattagataatgtaatgattacggatgaagaagagattcgtaccaccaatcctgtggcaacagagcagtatggaactgtggcaaataacttgcagagctcaaatacagctcccacgactggaactgtcaatcatcagggggccttacctggcatggtgtggcaagatcgtgacgtgtaccttcaaggacctatctgggcaaagattcctcacacggatggacactttcatccttctcctctgatgggaggctttggactgaaacatccgcctcctcaaatcatgatcaaaaatactccggtaccggcaaatcctccgacgactttcagcccggccaagtttgcttcatttatcactcagtactccactggacaggtcagcgtggaaattgagtgggagctacagaaagaaaacagcaaacgttggaatccagagattcagtacacttccaactacaacaagtctgttaatgtggactttactgtagacactaatggtgtttatagtgaacctcgccctattggaacccggtatctcacacgaaacttgtaa

SEQ ID NO: 201 - DNA, 2205 bp, Unknown
  adeno-associated virus serotype 4-4
atgactgacggttaccttccagattggctagaggacaacctctctgaaggcgttcgagagtggtgggcgctgcaacctggagcccctaaacccaaggcaaatcaacaacatcaggacaacgctcggggtcttgtgcttccgggttacaaatacctcggacccggcaacggactcgacaagggggaacccgtcaacgcagcggacgcggcagccctcgagcacgacaaggcctacgaccagcagctcaaggccggtgacaacccctacctcaagtacaaccacgccgacgcggagttccagcagcggcttcagggcgacacatcgtttgggggcaacctcggcagagcagtcttccaggccaaaaagagggttcttgaacctcttggtctggttgagcaagcgggtgagacggctcctggaaagaagagaccgttgattgaatccccccagcagcccgactcctccacgggtatcggcaaaaaaggcaagcagccggctaaaaagaagctcgttttcgaagacgaaactggagcaggcgacggaccccctgagggatcaacttccggagccatgtctgatgacagtgagatgcgtgcagcagctggcggagctgcagtcgagggcggacaaggtgccgatggagtgggtaatgcctcgggtgattggcattgcgattccacctggtctgagggccacgtcacgaccaccagcaccagaacctgggtcttgcccacctacaacaaccacctctacaagcgactcggagagagcctgcagtccaacacctacaacggattctccaccccctggggatactttgacttcaaccgcttccactgccacttctcaccacgtgactggcagcgactcatcaacaacaactggggcatgcgacccaaagccatgcgggtcaaaatcttcaacatccaggtcaaggaggtcacgacgtcgaacggcgagacaacggtggctaataaccttaccagcacggttcagatctttgcggactcgtcgtacgaactgccgtacgtgatggatgcgggtcaagagggcagcctgcctccttttcccaacgacgtctttatggtgccccagtacggctactgtggactggtgaccggcaacacttcgcagcaacagactgacagaaatgccttctactgcctggagtactttccttcgcagatgctgcggactggcaacaactttgaaattacgtacagttttgagaaggtgcctttccactcgatgtacgcgcacagccagagcctggaccggctgatgaaccctctcatcgaccagtacctgtggggactgcaatcgaccaccaccggaaccaccctgaatgccgggactgccaccaccaactttaccaagctgcggcctaccaacttttccaactttaaaaagaactggctgcccgggccttcaatcaagcagcagggcttctcaaagactgccaatcaaaactacaagatccctgccaccgggtcagacagtctcatcaaatacgagacgcacagcactctggacggaagatggagtgccctgacccccggacctccaatggccacggctggacctgcggacagcaagttcagcaacagccagctcatctttgcggggcctaaacagaacggcaacacggccaccgtacccgggactctgatcttcacctctgaggaggagctggcagccaccaacgccaccgatacggacatgtggggcaacctacctggcggtgaccagagcaacagcaacctgccgaccgtggacagactgacagccttgggagccgtgcctggaatggtctggcaaaacagagacatttactaccagggtcccatttgggccaagattcctcataccgatggacactttcacccctcaccgctgattggtgggtttgggctgaaacacccgcctcctcaaatttttatcaagaacaccccggtacctgcgaatcctgcaacgaccttcagctctactccggtaaactccttcattactcagtacagcactggccaggtgtcggtgcagattgactgggagatccagaaggagcggtccaaacgctggaaccccgaggtccagtttacctccaactacggacagcaaaactctctgttgtgggctcccgatgcggctgggaaatacactgagcctagggctatcggtacccgctacctcacccaccacctgtaa

SEQ ID NO: 202 - DNA, 2211 bp, Unknown; identical to SEQ ID NO: 79
  adeno-associated virus serotype 1

SEQ ID NO: 203 - DNA, 2211 bp, Unknown
  adeno-associated virus serotype 6
atggctgccgatggttatcttccagattggctcgaggacaacctctctgagggcattcgcgagtggtgggacttgaaacctggagccccgaaacccaaagccaaccagcaaaagcaggacgacggccggggtctggtgcttcctggctacaagtacctcggacccttcaacggactcgacaagggggagcccgtcaacgcggcggatgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagagggttctcgaaccttttggtctggttgaggaaggtgctaagacggctcctggaaagaaacgtccggtagagcagtcgccacaagagccagactcctcctcgggcattggcaagacaggccagcagcccgctaaaaagagactcaattttggtcagactggcgactcagagtcagtccccgacccacaacctctcggagaacctccagcaacccccgctgctgtgggacctactacaatggcttcaggcggtggcgcaccaatggcagacaataacgaaggcgccgacggagtgggtaatgcctcaggaaattggcattgcgattccacatggctgggcgacagagtcatcaccaccagcacccgaacatgggccttgcccacctataacaaccacctctacaagcaaatctccagtgcttcaacgggggccagcaacgacaaccactacttcggctacagcaccccctgggggtattttgatttcaacagattccactgccatttctcaccacgtgactggcagcgactcatcaacaacaattggggattccggcccaagagactcaacttcaagctcttcaacatccaagtcaaggaggtcacgacgaatgatggcgtcacgaccatcgctaataaccttaccagcacggttcaagtcttctcggactcggagtaccagttgccgtacgtcctcggctctgcgcaccagggctgcctccctccgttcccggcggacgtgttcatgattccgcagtacggctacctaacgctcaacaatggcagccaggcagtgggacggtcatccttttactgcctggaatatttcccatcgcagatgctgagaacgggcaataactttaccttcagctacaccttcgaggacgtgcctttccacagcagctacgcgcacagccagagcctggaccggctgatgaatcctctcatcgaccagtacctgtattacctgaacagaactcagaatcagtccggaagtgcccaaaacaaggacttgctgtttagccgggggtctccagctggcatgtctgttcagcccaaaaactggctacctggaccctgttaccggcagcagcgcgtttctaaaacaaaaacagacaacaacaacagcaactttacctggactggtgcttcaaaatataaccttaatgggcgtgaatctataatcaaccctggcactgctatggcctcacacaaagacgacaaagacaagttctttcccatgagcggtgtcatgatttttggaaaggagagcgccggagcttcaaacactgcattggacaatgtcatgatcacagacgaagaggaaatcaaagccactaaccccgtggccaccgaaagatttgggactgtggcagtcaatctccagagcagcagcacagaccctgcgaccggagatgtgcatgttatgggagccttacctggaatggtgtggcaagacagagacgtatacctgcagggtcctatttgggccaaaattcctcacacggatggacactttcacccgtctcctctcatgggcggctttggacttaagcacccgcctcctcagatcctcatcaaaaacacgcctgttcctgcgaatcctccggcagagttttcggctacaaagtttgcttcattcatcacccagtattccacaggacaagtgagcgtggagattgaatgggagctgcagaaagaaaacagcaaacgctggaatcccgaagtgcagtatacatctaactatgcaaaatctgccaacgttgatttcactgtggacaacaatggactttatactgagcctcgccccattggcacccgttacctcacccgtcccctgtaa

SEQ ID NO: 204 - DNA, 2208 bp, Unknown
  new AAV serotype, clone hu.63
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacagcggagacaacccgtaccccaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgcggagccagactcctcctcgggaaccggaaaagcgggccagcagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaagcagatttccagccaatcaggagcctcaaacgacaaccactactttggctacagcaccccttgggggtattttgacttcaacagattccactgccacttttcgccacgtgactggcaaagactcatcaacaacaattggggattccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcatcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccaggtacctgactcgtaatctgtaa

SEQ ID NO: 205 - DNA, 2208 bp, Unknown
  new AAV serotype, clone hu.56
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaagcgggcaaccagcctgcaagaaaaagattgaatttcggtcagactggagacgcagactccgtacctgacccccagcctctcggacagccaccagcatccccctctggtctgggaactaatacgatggctacaggcagtggcgcaccaatggcagacaataacgagggcgccgacggagtgggtaattcctcgggaaattggcattgcgattccacatggatgggcgacagagtcgtcaccaccagcacccgcacctgggccctgcccacctacaacaaccacctctacaagcagatttccagccaatcaggagccagcaacgacaaccactactttggctacagcaccccttgggggtattttgacttcaacagattccactgccacttttcgccacgcgactggcagagactcatcaacaacaactggggattccggcccaaaagactcaacttcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgcaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 206 - DNA, 2205 bp, Unknown
  new AAV serotype, clone hu.57
atggctgccgatggttatcttccagattggctcgaggacactctctctgaaggaataagacagtggtggaagctcaaacctggcccaccaccaaagcccgcagagcggcataaggacgacagcaggggtcttgtgcttcctggatacaagtacctcggacccttcaacggactcgacaagggagagccggtcaacgaggcagacgccgcggccctcgagcacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggcccgtagagcactctcctgtggagccagactcctcctcgggaaccggaaaagcgggcaaccagcctgcaagaaaaagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggagattggcattgcgattccacatggatgggcgacagagtcatcaccaccagcacccgcacctgggccctgcccacctacaacaaccacctctacaagcagatttccagccaatcaggagccagcaatgacaaccactactttggctacagcaccccttgggggtattttgacttcaacagattccactgccacttttcgccacgcgactggcagagactcatcaacaacaactggggattccggcccaaaagactcaacctcaagctgtttaacattcaagtcaaggaggtcacgcagaatgacggtacgacgacgattgccaataaccttaccagcacggttcaggtgtttactgacttggagtaccagctcccgtacgtcctcggctcggcgcatcaaggatgcctcccgccgttcccagcagacgtcttcatggtgccacagtatggatacctcaccctgaacaacgggagtcaggcggtaggacgctcttccttttactgcctggagtactttccttctcagatgcttcgtaccggaaacaactttaccttcagctacacttttgaagacgttcctttccacagcagctacgctcacagtcaaagtctggaccgtctcatgaatcctctcatcgaccagtacctgtattacttgagcagaacaaacactccaagcggaaccactacgcagtccaggcttcagttttctcaggccggagcgagtgacattcgggaccagtctaggaactggcttcctggaccctgttaccgccagcagcgagtatcaaagacagctgcggataacaacaacggtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcaggaccaccaatcccgtggctacggagcagtatggttctgtatctaccaacctccagagcggcaacacacgagcagctacctcagatgtcaacacacaaggcgttcttccaggcatggtctggcaggacagagacgtgtacctgcaggggcccatctgggcaaaaattccacacacggacggacattttcacccctctcccctcatgggcggatttggacttaaacaccctcctccacagattctcattaagaataccccggtacctgcgaatccttcgaccaccttcagcgcggcaaagtttgcttccttcatcacacagtattccacggggcaggtcagcgtggagatcgagtgggagctgcagaaggagaacagcaaacgctggaatcccgaaattcagtacacttccaactacaacaaatctgttaatgtggactttactgtggacactaatggggtgtattcagagcctcgccctattggcaccagatacctgactcgtaatctgtaa

SEQ ID NO: 207 - DNA, 2208 bp, Unknown
  new AAV serotype, clone hu.58
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaggcctacgaccggcagctcgacagcggagacaacccgtacctcaagtacgaccacgccgacgcggagtttcaggagcgccttaaagaagatacgtcttttgggggcaacctcggacgagcagtcttccaggcaaaaaagagggttcttgaacctctgggcctggttgaggagcctgttaagacggctccgggaaaaaagaggccggtagagcactctcctgtggagccagactcctcctcgggaaccggaaaagcgggcaaccagcctgcaagaaagagattgaatttcggtcagactggagacgcagactccgtacctgacccccagcctctcggacagccaccagcagccccctctggtctgggaactaatacgatggctacaggcagtggcgcaccaatggcagacaataacgatggcgccgacggagtgggtaattcctcgggaaattggcattgcgattccacatggatgggcgacagagtcatcaccaccagcacccgaacctgggctctgcccacctacaacaaccatctgtacaagcagatttccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcagagaggtcacgcagaatgatggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtacttcccttctcagatgctgcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcgagtgacattcgggatcagtctaggaactggcttcctggaccctgttaccgccagcagcgagtatcaaagacatctgcggacaacaacaacagtgaatactcgtggattggagctaccaagtaccacctcaatggcagagactctctggtgaatccgggcccggcaatggccagccacaaggacgatgaagaaaagttttttcctcagagcggggttctcatctttggaaaacaaggatcagagaaaacaaatgtggacattgaaaaggtcatgattacagacgaagaggaaatcagaaccaccaatcccgtggccacggagcagtatggttctgtatctaccaacctccagagcggcaacacacaagcatctactgcagatgtcaacacacaaggcgttcttccaggcatggtctggcaggacagagacgtgtacctgcaggggcctatctgggcaaagattccgcacacggacggacattttcacccctctcccctcatgggcggattcggacttaaacaccctcctccacagattctcatcaaaaacaccccggtacctgcgaatccttcgaccaccttcagtgcggcaaagtttgcttccttcatcacacagtattccacggggcgggtcagcgtggagatcgagtgggagctacagaaggagaacagcaaacgctggaatcccgagatccagtacacttccaactacaacaaatctgttaatgtggactttactgtggacactaatggtgtgtattcagagcctcgccccattggcaccagatacctgactcgtaatctgtaa

SEQ ID NO: 208 - DNA, 2208 bp, Unknown
  new AAV serotype, clone hu.51
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgtcaagacggctccaggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcggctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtacggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 209 - DNA, 2208 bp, Unknown
  new AAV serotype, clone hu.49
atggctgccgatggttatcttccagattggctcaaggacactctctctgaaggaataagacagtggtggaagctcaaacctggcccaccaccaccaaagcccgcagagcggcataaggacgacagcgggggtcttgtgcttcctgggtacaagtacctcggacccttcaacggactcgacaagggagagccggtcaacgaggcagacgccgcggccctcgagtacgacaaggcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaacaggaaaagcgggccagcagcctgcgagaaagagattgaattttggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaagttggcattgcgattccacatggatgggcgacagagtcatcaccaccagcacccgaacctgggctctgcccacctacaacaaccatctgtacaagcagatctccagccaatcaggagccagcaacgacaaccactactttggctacagcaccccttgggggtattttgacttcaacagattccactgccacttttcaccacgtgactggcaaagactcatcaacaacaactggggattccggcccaagagactcaacttcaagctctttaacattcaagtcaaggaggtcacgcagaatgacggtacgacgacgattgccaataaccttaccagcacggttcaggtgtttactgactcggagtaccagctcccgtacgtccccggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgcttcgtaccggaaacaactttaccttcagctacacctttgaggatgttcctttccacagcagctacgctcacagccagagtttggaccgtctcatgaatcctctcatcgaccagtacctgtattacttgagcagaacaaacactccaagcggaaccaccacgcagtccaggcttcagttttctcaggccggagcaagtgacattcgggaccagtctaggaactggcttcctggaccctgttaccgccagcagcgagtatcaaagacagctgcggacaacaacaacagtgaatactcgtggactggagctaccaagtaccacctcaatggcagagactctctggtgaatccgggcccggccatggccagccacaaggacgatgaagaaaagttttttcctcaaagcggggttctcatctttgggaagcaaggctcagagaaaacaaatgtggacattgaaaaggtcatgattacagacgaagaggaaatcagaaccaccaatcccgtggccacggagcagtatggttctgtatctaccaacctccagagcggcaacacacaagcagctactgcagatgtcaacacacaaggcgttcttccaggcatggtctggcaggacagagacgtgcacctgcaggggcctatctgggcaaagattccacacacggacggacattttcacccctctcccctcatgggcggatttggacttaaacaccctcctccacagattctcatcaagaacaccccggtacctgcaaatccttcgaccaccttcagtgcggcaaagtttgcttccttcatcacacagtattccacagggcaggtcagcgtggagatcgagtgggagctgcagaaggagaacagcaaacgctggaaccccgagatccagtacacttccaactacaacaaatctgttaatgtggactttactgtggacactaatggtgtgtattcagagcctcgccccattggcaccagatacctgactcgtaatctgtaa

SEQ ID NO: 210 - DNA, 2208 bp, Unknown
  new AAV serotype, clone hu.52
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttggggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaatcggcattgcgattccacatggatgggcgacagagtcatcaccaccagcacccgaacctgggccctgcccacctacaacaaccacctctacagacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgagcaacgggagtcaggcagtaggacgctcttcattttactgcccggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcacaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacaatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacctaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatttgtaa

SEQ ID NO: 211 - DNA, 2208 bp, Unknown
  adeno-associated virus serotype 2
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtacctcggacccttcaacggactcgacaagggagagccggtcaacgaggcagacgccgcggccctcgagcacgacaaagcctacgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgaacctgggccctgcccacctacaacaaccacctctacaaacaaatttccagccaatcaggagcctcgaacgacaatcactactttggctacagcaccccttgggggtattttgacttcaacagattccactgccacttttcaccacgtgactggcaaagactcatcaacaacaactggggattccgacccaagagactcaacttcaagctctttaacattcaagtcaaagaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacttttgaggacgttcctttccacagcagctacgctcacagccagagtctggaccgtctcatgaatcctctcatcgaccagtacctgtattacttgagcagaacaaacactccaagtggaaccaccacgcagtcaaggcttcagttttctcaggccggagcgagtgacattcgggaccagtctaggaactggcttcctggaccctgttaccgccagcagcgagtatcaaagacatctgcggataacaacaacagtgaatactcgtggactggagctaccaagtaccacctcaatggcagagactctctggtgaatccgggcccggccatggcaagccacaaggacgatgaagaaaagttttttcctcagagcggggttctcatctttgggaagcaaggctcagagaaaacaaatgtggacattgaaaaggtcatgattacagacgaagaggaaatcaggacaaccaatcccgtggctacggagcagtatggttctgtatctaccaacctccagagaggcaacagacaagcagctaccgcagatgtcaacacacaaggcgttcttccaggcatggtctggcaggacagagatgtgtaccttcaggggcccatctgggcaaagattccacacacggacggacattttcacccctctcccctcatgggtggattcggacttaaacaccctcctccacagattctcatcaagaacaccccggtacctgcgaatccttcgaccaccttcagtgcggcaaagtttgcttccttcatcacacagtactccacgggacaggtcagcgtggagatcgagtgggagctgcagaaggaaaacagcaaacgctggaatcccgaaattcagtacacttccaactacaacaagtctgttaatgtggactttactgtggacactaatggcgtgtattcagagcctcgccccattggcaccagatacctgactcgtaatctgtaa

SEQ ID NO: 212 - DNA, 2208 bp, Unknown
  new AAV serotype, clone hu.64
atggctgccgatggttatcttccagattggctcgaggacactctctctgaaggaataagacagtggtggaagctcaaacctggcccaccaccaccaaagcccgcagagcggcataaggacgacagcaggggtcttgtgcttcctgggtacaagtaccttggacccttcaacggactcgacaagggagagccggtcaacgaggcagacgccgcggccctcgagcacgacaaggcctacgaccggcagctcgacggcggagacaacccgtacctcaagtacaaccacgccgacgcggagttccaggagcgtcttaaagaagatacgtcttttgggggcaacctcggacgagcagtcttccaggcgaaaaagagggttcttgaacctctgggcctggttgaggaacctgttaagacggctccgggaaaaaagaggccggtagagcactctcttgcggagccagactcctcctcgggaaccggaaaagcgggccagcagcctgcaagaaggagattgaatttcggtcagactggagacgcagactccgtacctgacccccagcctctcggacagccaccagcagccccctctggtctgggaactaatacgatggctacaggcagtggcgcaccaatggcagacaataacgagggcgccgacggagtgggtaattcctcgggaaattggcattgcgattccacatggatgggcgacagagtcatcaccaccagcacccgcacctgggctctgcccacctacaacaaccacctctacaggcagatttccagccaatcaggagcctcaaacgacaaccactactttggctacagcaccccttgggggtattttgacttcaacagattccactgccacttttcgccacgtgactggcaaagactcatcaacaacaattggggatcccggcccaaaagactcaacttcaagctctttaacattcaagtcaaggaggtcacgcagaatgacggtacgacgacgattgccaataaccttaccagcacggttcaggtgtttactgactcggagtaccagctcccgtacgtcctcggctcggcgcatcaaggatgcctcccgccgttcccagcagacgtcttcatggtgccacagtatggatacctcaccctgaacaacgggagtcaggcagtaggacgctcttcattttactgcctggagtactttccttctcagatgctgcgtaccggaaacaactttaccttcagctacacctttgaggacgttcctttccacagcagctacgcccacagccagagtttggaccgtctcatgaatcctctcgtcgaccagtacctgtattacttgagcagaacaaacactccaagcggaaccaccacgcagtcaaggcttcagttttctcaggccggagcaagtgacattcgggaccagtctaggaactggcttcctggaccctgttaccgccagcagcgagtatcaaagacatctgcggataacaacaacagtgaatactcgtggactggagctaccaagtaccaccttaatggaagagactctctggtgaatccgggcccggccatggccagccacaaggacgatgaagaaaagttttttcctcagagcggggttctcatctttggaaaacaagactcgggaaaaactaatgtggacattgaaaaggtcatgattacagacgaagaggaaatcaggaccaccaatcccgtggctacggagcagtatggttctgtatctaccaacctccagagcggcaacacacaagcagctacctcagatgtcaacacacaaggcgttcttccaggcatggtgtggcaggacagagacgtgtacctgcaggggcccatctgggcaaagattccacacacggacggacattttcacccctctcccctcatgggcggattcggacttaaacaccctcccccgcagattctcatcaagaacaccccggtacctgcgaatccttcgactaccttcagtgcggcaaagtttgcttccttcattacacagtactccacggggcaggtcagcgtggagatcgagtgggagctgcagaaggagaacagcaaacgctggaatcccgagattcagtacacttccaactacaacaaatctgttaatgtggactttactgtggacactaatggtgtgtattcagagcctcgccccattggcaccagatacctgactcgtaatctgtaa

SEQ ID NO: 213 - DNA, 2214 bp, Unknown
  adeno-associated virus serotype 7
atggctgccgatggttatcttccagattggctcgaggacaacctctctgagggcattcgcgagtggtgggacctgaaacctggagccccgaaacccaaagccaaccagcaaaagcaggacaacggccggggtctggtgcttcctggctacaagtacctcggacccttcaacggactcgacaagggggagcccgtcaacgcggcggacgcagcggccctcgagcacgacaaggcctacgaccagcagctcaaagcgggtgacaatccgtacctgcggtataaccacgccgacgccgagtttcaggagcgtctgcaagaagatacgtcatttgggggcaacctcgggcgagcagtcttccaggccaagaagcgggttctcgaacctctcggtctggttgaggaaggcgctaagacggctcctgcaaagaagagaccggtagagccgtcacctcagcgttcccccgactcctccacgggcatcggcaagaaaggccagcagcccgccagaaagagactcaatttcggtcagactggcgactcagagtcagtccccgaccctcaacctctcggagaacctccagcagcgccctctagtgtgggatctggtacagtggctgcaggcggtggcgcaccaatggcagacaataacgaaggtgccgacggagtgggtaatgcctcaggaaattggcattgcgattccacatggctgggcgacagagtcattaccaccagcacccgaacctgggccctgcccacctacaacaaccacctctacaagcaaatctccagtgaaactgcaggtagtaccaacgacaacacctacttcggctacagcaccccctgggggtattttgactttaacagattccactgccacttctcaccacgtgactggcagcgactcatcaacaacaactggggattccggcccaagaagctgcggttcaagctcttcaacatccaggtcaaggaggtcacgacgaatgacggcgttacgaccatcgctaataaccttaccagcacgattcaggtattctcggactcggaataccagctgccgtacgtcctcggctctgcgcaccagggctgcctgcctccgttcccggcggacgtcttcatgattcctcagtacggctacctgactctcaacaatggcagtcagtctgtgggacgttcctccttctactgcctggagtacttcccctctcagatgctgagaacgggcaacaactttgagttcagctacagcttcgaggacgtgcctttccacagcagctacgcacacagccagagcctggaccggctgatgaatcccctcatcgaccagtacttgtactacctggccagaacacagagtaacccaggaggcacagctggcaatcgggaactgcagttttaccagggcgggccttcaactatggccgaacaagccaagaattggttacctggaccttgcttccggcaacaaagagtctccaaaacgctggatcaaaacaacaacagcaactttgcttggactggtgccaccaaatatcacctgaacggcagaaactcgttggttaatcccggcgtcgccatggcaactcacaaggacgacgaggaccgctttttcccatccagcggagtcctgatttttggaaaaactggagcaactaacaaaactacattggaaaatgtgttaatgacaaatgaagaagaaattcgtcctactaatcctgtagccacggaagaatacgggatagtcagcagcaacttacaagcggctaatactgcagcccagacacaagttgtcaacaaccagggagccttacctggcatggtctggcagaaccgggacgtgtacctgcagggtcccatctgggccaagattcctcacacggatggcaactttcacccgtctcctttgatgggcggctttggacttaaacatccgcctcctcagatcctgatcaagaacactcccgttcccgctaatcctccggaggtgtttactcctgccaagtttgcttcgttcatcacacagtacagcaccggacaagtcagcgtggaaatcgagtgggagctgcagaaggaaaacagcaagcgctggaacccggagattcagtacacctccaactttgaaaagcagactggtgtggactttgccgttgacagccagggtgtttactctgagcctcgccctattggcactcgttacctcacccgtaatctgtaa

SEQ ID NO: 214 - DNA, 2217 bp, Unknown
  adeno-associated virus serotype 8
atggctgccgatggttatcttccagattggctcgaggacaacctctctgagggcattcgcgagtggtgggcgctgaaacctggagccccgaagcccaaagccaaccagcaaaagcaggacgacggccggggtctggtgcttcctggctacaagtacctcggacccttcaacggactcgacaagggggagcccgtcaacgcggcggacgcagcggccctcgagcacgacaaggcctacgaccagcagctgcaggcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaaggcgctaagacggctcctggaaagaagagaccggtagagccatcaccccagcgttctccagactcctctacgggcatcggcaagaaaggccaacagcccgccagaaaaagactcaattttggtcagactggcgactcagagtcagttccagaccctcaacctctcggagaacctccagcagcgccctctggtgtgggacctaatacaatggctgcaggcggtggcgcaccaatggcagacaataacgaaggcgccgacggagtgggtagttcctcgggaaattggcattgcgattccacatggctgggcgacagagtcatcaccaccagcacccgaacctgggccctgcccacctacaacaaccacctctacaagcaaatctccaacgggacatcgggaggagccaccaacgacaacacctacttcggctacagcaccccctgggggtattttgactttaacagattccactgccacttttcaccacgtgactggcagcgactcatcaacaacaactggggattccggcccaagagactcagcttcaagctcttcaacatccaggtcaaggaggtcacgcagaatgaaggcaccaagaccatcgccaataacctcaccagcaccatccaggtgtttacggactcggagtaccagctgccgtacgttctcggctctgcccaccagggctgcctgcctccgttcccggcggacgtgttcatgattccccagtacggctacctaacactcaacaacggtagtcaggccgtgggacgctcctccttctactgcctggaatactttccttcgcagatgctgagaaccggcaacaacttccagtttacttacaccttcgaggacgtgcctttccacagcagctacgcccacagccagagcttggaccggctgatgaatcctctgattgaccagtacctgtactacttgtctcggactcaaacaacaggaggcacggcaaatacgcagactctgggcttcagccaaggtgggcctaatacaatggccaatcaggcaaagaactggctgccaggaccctgttaccgccaacaacgcgtctcaacgacaaccgggcaaaacaacaatagcaactttgcctggactgctgggaccaaataccatctgaatggaagaaattcattggctaatcctggcatcgctatggcaacacacaaagacgacgaggagcgtttttttcccagtaacgggatcctgatttttggcaaacaaaatgctgccagagacaatgcggattacagcgatgtcatgctcaccagcgaggaagaaatcaaaaccactaaccctgtggctacagaggaatacggtatcgtggcagataacttgcagcagcaaaacacggctcctcaaattggaactgtcaacagccagggggccttacccggtatggtctggcagaaccgggacgtgtacctgcagggtcccatctgggccaagattcctcacacggacggcaacttccacccgtctccgctgatgggcggctttggcctgaaacatcctccgcctcagatcctgatcaagaacacgcctgtacctgcggatcctccgaccaccttcaaccagtcaaagctgaactctttcatcacgcaatacagcaccggacaggtcagcgtggaaattgaatgggagctgcagaaggaaaacagcaagcgctggaaccccgagatccagtacacctccaactactacaaatctacaagtgtggactttgctgttaatacagaaggcgtgtactctgaaccccgccccattggcacccgttacctcacccgtaatctgtaa

SEQ ID NO: 215 - DNA, 2217 bp, Unknown
  new AAV serotype, clone hu.67
atggctgctgacggttatcttccagattggctcgaggacaacctctctgagggcattcgcgagtggtgggacctgaaacctggagcccccaagcccaaggccaaccagcagaagcaggacgacggccggggtctggtgcttcttggctacaagtacctcggacccttcaacggactcgacaagggggagcccgtcaatgcggcggacgcagcggccctcgagcacgacaaggcctacgaccagcagctcaaagcgggtgacaatccgtacctgcggtataaccacgccgacgccgagtttcaggagcgtctgcaagaagatacgtcttttgggggcaacctcgggcgagcagtcttccaggccaagaagcgggttctcgaacctctcggtctggttgaggaagctgctaagacggctcctggaaagaagagaccggtagaaccgtcacctcagcgttcccccgactcctccacgggcatcggcaagaaaggccagcagcccgctaaaaagagactgaactttggtcagactggcgactcagagtcagtccccgaccctcaaccaatcggagaaccaccagcaggcccctctggtctgggatctggtacaatggctgcaggcggtggcgctccaatggcagacaataacgaaggcgccgacggagtgggtagttcctcaggaaattggcattgcgattccacatggctgggcgacagagtcatcaccaccagcacccgaacctgggccctgcccacctacaacaaccacctctacaagcaaatatccaatgggacatcgggaggaagcaccaacgacaacacctacttcggctacagcaccccctgggggtattttgacttcaacagattccactgccacttctcaccacgtgactggcagcgactcatcaacaacaactggggattccggccaaaaagactcagcttcaagctcttcaacatccaggtcaaggaggtcacgcagaatgaaggcaccaagaccatcgccaataaccttaccagcacgattcaggtatttacggactcggaataccagctgccgtacgtcctcggctccgcgcaccagggctgcctgcctccgttcccggcggacgtcttcatgattccccagtacggctaccttacactgaacaatggaagtcaagccgtaggccgttcctccttctactgcctggaatattttccatctcaaatgctgcgaactggaaacaattttgaattcagctacaccttcgaggacgtgcctttccacagcggctacgcacacagccagagcttggaccgactgatgaatcctctcatcgaccagtacctgtactacttatccagaactcagtccacaggaggaactcaaggtacccagcaattgttattttctcaagctgggcctgcaaacatgtcggctcaggctaagaactggctacctggaccttgctaccggcagcagcgagtctctacgacactgtcgcaaaacaacaacagcaactttgcttggactggtgccaccaaatatcacctgaacggaagagactctttggtaaatcccggtgtcgccatggcaacccacaaggacgacgaggaacgcttcttcccgtcgagtggagtcctgatgtttggaaaacagggtgctggaagagacaatgtggactacagcagcgttatgctaaccagcgaagaagaaattaaaaccactaaccctgtagccacagaacaatacggtgtggtggctgacaacttgcagcaaaccaatacagggcctattgtgggaaatgtcaacagccaaggagccttacctggcatggtctggcagaaccgagacgtgtacctgcagggtcccatctgggccaagattcctcacacggacggcaacttccacccttcaccgctaatgggaggatttggactgaagcacccacctcctcagatcctgatcaagaacacgccggtacctgcggatcctccaacgacgttcagccaggcgaaattggcttccttcattacgcagtacagcaccggacaggtcagcgtggaaatcgagtgggagctgcagaaggagaacagcaaacgctggaacccagagattcagtacacttcaaactactacaaatctacaaatgtggactttgctgtcaatacagagggaacttattctgagcctcgccccattggtactcgttacctcacccgtaatctgtaa

SEQ ID NO: 216 - protein, 724 aa, Unknown
  vp1, serotype 5
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 217 - protein, 736 aa, Unknown
  vp1, serotype 3-3
MAADGYLPDWLEDNLSEGIREWWALKPGVPQPKANQQHQDNRRGLVLPGYKYLGPGNGLDKGEPVNEADAAALEHDKAYDQQLKAGDNPYLKYNHADAEFQERLQEDTSFGGNLGRAVFQAKKRILEPLGLVEEAAKTAPGKKGAVDQSPQEPDSSSGVGKSGKQPARKRLNFGQTGDSESVPDPQPLGEPPAAPTSLGSNTMASGGGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKKLSFKLFNIQVRGVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNRTQGTTSGTTNQSRLLFSQAGPQSMSLQARNWLPGPCYRQQRLSKTANDNNNSNFPWTAASKYHLNGRDSLVNPGPAMASHKDDEEKFFPMHGNLIFGKEGTTASNAELDNVMITDEEEIRTTNPVATEQYGTVANNLQSSNTAPTTGTVNHQGALPGMVWQDRDVYLQGPIWAKIPHTDGHFHPSPLMGGFGLKHPPPQIMIKNTPVPANPPTTFSPAKFASFITQYSTGQVSVEIEWELQKENSKRWNPEIQYTSNYNKSVNVDFTVDTNGVYSEPRPIGTRYLTRNL

SEQ ID NO: 218 - protein, 734 aa, Unknown
  vp1, serotype 4-4
MTDGYLPDWLEDNLSEGVREWWALQPGAPKPKANQQHQDNARGLVLPGYKYLGPGNGLDKGEPVNAADAAALEHDKAYDQQLKAGDNPYLKYNHADAEFQQRLQGDTSFGGNLGRAVFQAKKRVLEPLGLVEQAGETAPGKKRPLIESPQQPDSSTGIGKKGKQPAKKKLVFEDETGAGDGPPEGSTSGAMSDDSEMRAAAGGAAVEGGQGADGVGNASGDWHCDSTWSEGHVTTTSTRTWVLPTYNNHLYKRLGESLQSNTYNGFSTPWGYFDFNRFHCHFSPRDWQRLINNNWGMRPKAMRVKIFNIQVKEVTTSNGETTVANNLTSTVQIFADSSYELPYVMDAGQEGSLPPFPNDVFMVPQYGYCGLVTGNTSQQQTDRNAFYCLEYFPSQMLRTGNNFEITYSFEKVPFHSMYAHSQSLDRLMNPLIDQYLWGLQSTTTGTTLNAGTATTNFTKLRPTNFSNFKKNWLPGPSIKQQGFSKTANQNYKIPATGSDSLIKYETHSTLDGRWSALTPGPPMATAGPADSKFSNSQLIFAGPKQNGNTATVPGTLIFTSEEELAATNATDTDMWGNLPGGDQSNSNLPTVDRLTALGAVPGMVWQNRDIYYQGPIWAKIPHTDGHFHPSPLIGGFGLKHPPPQIFIKNTPVPANPATTFSSTPVNSFITQYSTGQVSVQIDWEIQKERSKRWNPEVQFTSNYGQQNSLLWAPDAAGKYTEPRAIGTRYLTHHL

SEQ ID NO: 219 - protein, 736 aa, Unknown; identical to SEQ ID NO: 162
  vp1, serotype 1

SEQ ID NO: 220 - protein, 736 aa, Unknown
  vp1, serotype 6
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPFGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDKDKFFPMSGVMIFGKESAGASNTALDNVMITDEEEIKATNPVATERFGTVAVNLQSSSTDPATGDVHVMGALPGMVWQDRDVYLQGPIWAKIPHTDGHFHPSPLMGGFGLKHPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 221 - protein, 735 aa, Unknown [sequence omitted]

SEQ ID NO: 222 - protein, 737 aa, Unknown; identical to SEQ ID NO: 181
  vp1, serotype 7

SEQ ID NO: 223 - protein, 738 aa, Unknown; identical to SEQ ID NO: 183
  vp1, serotype 8

SEQ ID NO: 224 - protein, 736 aa, Unknown
  vp1, modified hu.46
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEGAKTAPGKKRPVEQSPQEPDSSSGIGKTGQQPAKKRLNFGQTGDSESVPDPQPLGEPPATPAAVGPTTMASGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSCAHSQSLDRLMNPLIDQYLYYLNRTQNQSGSAQNRDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSANVDFTVDNNGLYTEPRPIGTRYLTRPL

SEQ ID NO: 225 - protein, 735 aa, Unknown
  vp1, modified hu.29
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEEPVKTAPGKKRPVEHSPAEPDSSSGTGKSGNQPARKRLNFGQTGDSDSVPDPQPLGQPPAAPSGLGTNTMATGSGAPMADNNEGADGVGNSSGNWHCDSTWMGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGPEKTNVDIEKVMITDEEEIRTTNPVATEQYGSVSTNLQSGNTQAATADVNTQGVLPGMVWQDRDVYLQGPIWAKIPHTDGHFHPSPLMGGFGLKHPPPQILIKNTPVPANPSTTFSAAKFASFITQYSTGQVSVEIEWELQKENSKRWNPEIQYTSNYNKSVNVDFTVDTNGVYSEPRPIGTRYLTRNL

SEQ ID NO: 226 - protein, 735 aa, Unknown
  vp1, modified hu.7
MAADGYLPDWLEDTLSEGIRQWWKLKPGPPPPKPAERHKDDSRGLVLPGYKYLGPFNGLDKGEPVNEADAAALEHDKAYDRQLDSGDNPYLKYNHADAEFQERLKEDTSFGGNLGRAVFQAKKRVLEPLGLVEPPVKTAPGKKRPVEHSPAEPDSSSGTGKAGQQPARKRLNFGQTGDADSVPDPQPLGQPPAAPSGLGSTTMATGSGAPMADNNEGADGVGNSSGNWHCDSQWLGDRVITTSTRTWALPTYNNHLYKQISSQSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFQFSYTFEDVPFHSSYAHSQSLDRLMNPLIDQYLYYLNKTQSNSGTLQQSRLLFSQAGPTSMSLQAKNWLPGPCYRQQRLSKQANDNNNSNFPWTAATKYHLNGRDSLVNPGPAMASHKDDEEKFFPMHGTLIFGKQGTNANDADLDNVMITDEEEIRTTNPVATEQYGYVSNNLQNSNTGPTTGTVNHQGALPGMVWQDRDVYLQGPIWAKIPHTDGHFHPSPLMGGFGLKHPPPQIMIKNTPVPANPPTNFSSAKFASFITQYSTGQVSVEIEWELQKENSKRWNPEIQYTSNYNKSVNVDFTVDTNGVYSEPRPIGTRYLTRNL

SEQ ID NO: 227 - protein, 728 aa, Unknown
  vp1, modified cy.5
MAADGYLPDWLEDNLSEGIREWWDLKPGAPKPKANQQKQDDGRGLVLPGYRYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKNGQPPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 228 - protein, 728 aa, Unknown
  vp1, modified rh.13
MAADGYLPDWLEDNLSEGIREWWDLKPGAPKPKANQQKQDDGRGLVLPGYKYLGPFNGLDKGEPVNEADAAALEHDKAYDKQLEQGDNPYLKYNHADAEFQERLQEDTSFGGNLGRAVFQAKKRVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSGATNDNHFFGYSTPWGYFDFNRFHCHFSPRDWQRLINNNWGFRPRKLRFKLFNIQVKEVTTNDGVTTIANNLTSTIQVFSDSEYQLPYVLGSAHQGCLPPFPADVFMIPQYGYLTLNNGSQSVGRSSFYCLEYFPSQMLRTGNNFEFSYTFEEVPFHSSYAHSQSLDRLMNPLIDQYLYYLARTQSTTGSTRELQFHQAGPNTMAEQSKNWLPGPCYRQQRLSKNIDSNNNSNFAWTGATKYHLNGRNSLTNPGVAMATNKDDEDQFFPINGVLVFGKTGAANKTTLENVLMTSEEEIKTTNPVATEEYGVVSSNLQSSTAGPQTQTVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNNEGVYTEPRPIGTRYLTRNL

SEQ ID NO: 229 - protein, 729 aa, Unknown
  vp1, modified rh.37
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPIDSPDSSTGIGKKGQQPAKKKLNFGQTGDSESVPDPQPLGEPPAAPSSVGSGTMAAGGGAPTADNNEGADGVGNASGNWHCDSTWLGDRVITTSTRTWALPTYNNHLYKQISSSSSGATNDNHYFGYSTPWGYFDFNRFHCHFSPRDWQRLINNNWGFRPKKLRFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFEFSYSFEDVPFHSSYAHSQSLDRLMNPLIDQYLYYLARTQSTTGSTRELQFHQAGPNTMAEQSKNWLPGPCYRQQRLSKNLDFNNNSNFAWTAATKYHLNGRNSLTNPGIPMATNKDDEDQFFPINGVLVFGKTGAANKTTLENVLMTSEEEIKTTNPVATEEYGVVSSNLQSSTAGPQSQTINSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNYAKSNNVEFAVNPDGVYTEPRPIGTRYLTRNL

SEQ ID NO: 230 - protein, 737 aa, Unknown
  vp1, modified rh.67
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAGPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGVAMATHKDDEERFFPSSGVLIFGKTGAANKTTLENVLMTNEEEIRPTNPVATEEYGTVSSNLQAANTAAQTQVVNNQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGTRYLTRNL

SEQ ID NO: 231 - protein, 738 aa, Unknown
  vp1, modified rh.2
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGHQPARKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVPGSAHQGCLPPFPADVFMIPQYGYLTLNNGSQAVGRSSFYCLEYFPSQMLRTGNNFEFSYTFEDVPFHSSYAHSQSLDRLMNPLIDQYLYYLSRTQSTGGTQGTQQLLFSQAGPANMSAQAKNWLPGPCYRQQRVSTTLSQNNNSNFAWTGATKYHLNGRDSLVNPGVAMATHKDDEERFFPSSGVLMFGKQGAGKDNVDYSSVMLTSEEEIKTTNPVATEQYGVVADNLQQTNGAPIVGTVNSQGALPGMVWQNRDVYLQGPIWAKIPHTDGNFHPSPLMGGFGLKHPPPQILIKNTPVPADPPTTFSQAKLASFITQYSTGQVSVEIEWELQKENSKRWNPEIQYTSNYYKSTNVDFAVNTEGTYSEPRPIGTRYLTRNL

SEQ ID NO: 232 - protein, 738 aa, Unknown
  vp1, modified rh.58
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEAAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKSTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 233 - protein, 738 aa, Unknown
  vp1, modified rh.64
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEPSPQRSPDSSTGIGKKGQQPARKRLNFGQTGDSESVPDPQPIGEPPAAPSSVGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLSFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFSFSYTFEDVPFHSSYAHSQSLDRLMNPLIDQYLYYLSRTQSTGGTAGTQQLLFSQAGPSNMSAQARNWLPGPCYRQQRVSTTLSQNNNSNFAWTGATKYHLNGRDSLVNPGVAMATNKDDEDRFFPSSGILMFGKQGAGKDNVDYSNVMLTSEEEIKTTNPVATEQYGVVADNLQQQNTAPIVGAVNSQGALPGMVWQNRDVYLQGPIWAKIPHTDGNFHPSPLMGGFGLKHPPPQILIKNTPVPADPPTAFNQAKLNSFITQYSTGQVSVEIEWELQKENSKRWNPEIQYTSNYYKSTNVDFAVNTEGVYSEPRPIGTRYLTRNL

SEQ ID NO: 234 - protein, 735 aa, Unknown
  vp1, modified ch.5
MAADGYLPDWLEDTLSEGIRQWWKLKPGPPPPKPNQQHRDDSRGLVLPGYKYLGPFNGLDKGEPVNEADAAALEHDKAYDHQLKQGDNPYLKYNHADAEFQERLQEDTSFGGNLGRAVFQAKKRVLEPLGLVEEAVKTAPGKKRPIEQSPAEPDSSSGIGKSGQQPAKKRLNFGQTGDTESVPDPQPIGEPPAAPSGVGSNTMASGGGAPMADNNEGADGVGNSSGNWHCDSTWMGDRVITTSTRTWALPTYNNHLYKQISSESGATNDNHYFGYSTPWGYFDFNRFHCHFSPRDWQRLINNNWGFRPKKLNFKLFNIQVKEVTQNDGTTTIANNLTSTVQVFTDSEYQLPYVLGSAHQGCLPPFPADVFMIPQYGYLTLNNGSQAVGRSSFYCLEYFPSQMLRTGNNFTFSYTFEDVPFHSSYAHSQSLDRLMNPLIDQYLYYLSKTQGTSGTTQQSRLQFSQAGPSSMAQQAKNWLPGPSYRQQRMSKTANDNNNSEFAWTAATKYYLNGRNSLVNPGPPMASHKDDEEKYFPMHGNLIFGKQGTGTTNVDIESVLITDEEEIRTTNPVATEQYGQVATNHQSQNTTASYGSVDSQGILPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVEFTVDANGVYSEPRPIGTRYLTRNL

SEQ ID NO: 235 - protein, 736 aa, Unknown
  vp1, modified rh.8
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKTGQQPAKKRLNFGQTGDSESVPDPQPLGEPPAAPSGLGPNTMASGGGAPMADNNEGADGVGNSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTTNEGTKTIANNLTSTVQVFTDSEYQLPYVLGSAHQGCLPPFPADVFMVPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQAGPSSMANQARNWVPGPCYRQQRVSTTTNQNNNSNFAWTGAAKFKLNGRDSLMNPGVAMASHKDDEDRFFPSSGVLIFGKQGAGNDGVDYSQVLITDEEEIKATNPVATEEYGAVAINNQAANTQAQTGLVHNQGVIPGMVWQNRDVYLQGPIWAKIPHTDGNFHPSPLMGGFGLKHPPPQILIKNTPVPADPPLTFNQAKLNSFITQYSTGQVSVEIEWELQKENSKRWNPEIQYTSNYYKSTNVDFAVNTEGVYSEPRPIGTRYLTRNL

SEQ ID NO: 236 - protein, 737 aa, Unknown
  vp1, modified hu.43
MAADGYLPDWLEDNLSEGIREWWDLKPGAPKPKANQQKQDDGRGLVLPGYKYLGPFNGLDKGEPVNAADAAALEHDKAYDQQLKAGDNPYPRYNHADAEFQERLQEDTSFGGNLGRAVFQAKKRVLEPLGLVEEAAKTAPGKKRPVEPSPQRSPDSSTGIGKKGQQPAKKRLNFGQTGDSESVPDPQPIGEPPAGPSGLGSGTMAAGGGAPMADNNEGADGVGNASGNWHCDSTWLGDRVITTSTRTWALPTYNNHLYKQISSASTGASNDNHYFGYSTPWGYFDFNRFHCHFSPRDWQRLINNNWGFRPKRLNFKLFNIQVKEVTTNDGVTTIANNLTSTVQVFSDSEYQLPYVLGSAHQGCLPPFPADVFMIPQYGYLTLNNGSQAVGRSSFYCLEYFPSQMLRTGNNFTFSYTFEEVPLHSSYAHSQSLDRLMNPLIDQYLYYLNRTQNQSGSAQNKDLLFSRGSPAGMSVQPKNWLPGPCYRQQRVSKTKTDNNNSNFTWTGASKYNLNGRESIINPGTAMASHKDDEDKFFPMSGVMIFGKESAGASNTALDNVMITDEEEIKATNPVATERFGTVAVNFQSSSTDPATGDVHAMGALPGMVWQDRDVYLQGPIWAKIPHTDGHFHPSPLMGGFGLKNPPPQILIKNTPVPANPPAEFSATKFASFITQYSTGQVSVEIEWELQKENSKRWNPEVQYTSNYAKSASVDFTVDNNGLYTEPRPIGTRYLTRPL

The invention claimed is:

1. A non-naturally occurring adeno-associated virus (AAV) comprising an AAV9 capsid wherein the AAV9 capsid comprises AAV9 capsid proteins with an amino acid sequence selected from the group consisting of: the amino acids (aa) 1 to 736 of SEQ ID NO:123; the aa 138 to 736 of SEQ ID NO: 123; and the aa 2O3 to 736 of SEQ ID NO: 123, said AAV further comprising a minigene having AAV inverted terminal repeats and a transgene comprising a heterologous gene operably linked to regulatory sequences which direct expression of the heterologous gene in a host cell.

2. The AAV according to claim 1, wherein the amino acid sequence is encoded by a nucleic acid sequence selected from the group consisting of: the nucleotides (nt) 1 to 2211 of SEQ ID NO: 3; the nt 411 to 2211 of SEQ ID NO:3; and the nt 609 to 2211 of SEQ ID NO:3.

3. A composition comprising the non-naturally occurring AAV according to claim 1 and a phyusiologically compatible carrier.

4. A method of delivering the transgene of claim 1 to a cell, said method comprising the step of contacting the cell with the non-naturally occurring AAV according to claim 1.

5. An AAV comprising an AAV9 capsid, wherein the AAV9 capsid comprises an amino acid sequence that is at least 95% identical to amino acids 203 to 736 of SEQ ID NO: 123,and wherein said AAV further comprises a minigene having AAV inverted terminal repeats and a transgene comprising a heterologous gene operably linked to regulatory sequences which direct expression of the heterologous gene in a host cell, wherein said amino acid sequence is selected from the group consisting of SEQ ID NO: 121 and SEQ ID NO: 122.

6. A method of delivering the transgene to a cell, said method comprising the step of contacting the cell with the AAV according to claim 5.

7. The method according to claim 6, wherein the transgene encodes a protein selected from the group consisting of: a low density lipoprotein (LDL) receptor, a high density lipoprotein (HDL) receptor, a very low density lipoprotein (VLDL) receptor and a scavenger receptor.

* * * * *